US012807977B2

(12) United States Patent
Tournaviti et al.

(10) Patent No.: US 12,807,977 B2
(45) Date of Patent: Nov. 24, 2026

(54) OLIGONUCLEOTIDES TARGETING XBP1

(71) Applicants: Hoffmann-La Roche Inc., Little Falls, NJ (US); Roche Innovation Center Copenhagen A/S, Hørsholm (DK)

(72) Inventors: Styliani Tournaviti, Penzberg (DE); Jonas Vikesaa, Hørsholm (DK); Shan-Hua Chung, Penzberg (DE)

(73) Assignees: Hoffmann-La Roche Inc., Little Falls, NJ (US); Roche Innovation Center Copenhagen A/S, Hørsholm (DK)

( * ) Notice: Subject to any disclaimer, the term of this patent is extended or adjusted under 35 U.S.C. 154(b) by 524 days.

(21) Appl. No.: 18/340,016

(22) Filed: Jun. 22, 2023

(65) Prior Publication Data

US 2023/0323421 A1 Oct. 12, 2023

Related U.S. Application Data

(63) Continuation of application No. PCT/EP2021/086382, filed on Dec. 17, 2021.

(30) Foreign Application Priority Data

Dec. 22, 2020 (EP) .................................... 20216690

(51) Int. Cl.
*C12P 21/00* (2006.01)
*C07K 16/06* (2006.01)
*C12N 15/113* (2010.01)

(52) U.S. Cl.
CPC .............. *C12P 21/00* (2013.01); *C07K 16/06* (2013.01); *C12N 15/113* (2013.01); *C07K 2317/31* (2013.01); *C07K 2317/35* (2013.01); *C07K 2319/30* (2013.01); *C12N 2310/11* (2013.01); *C12N 2310/315* (2013.01); *C12N 2310/321* (2013.01); *C12N 2310/3231* (2013.01)

(58) Field of Classification Search
None
See application file for complete search history.

(56) References Cited

U.S. PATENT DOCUMENTS

| | | | |
|---|---|---|---|
| 4,676,980 | A | 6/1987 | Segal et al. |
| 4,816,567 | A | 3/1989 | Cabilly et al. |
| 5,731,168 | A | 3/1998 | Carter et al. |
| 7,514,237 | B2 | 4/2009 | Gao et al. |
| 2002/0004587 | A1 | 1/2002 | Miller et al. |
| 2006/0053502 | A1 | 3/2006 | Gao et al. |
| 2008/0069820 | A1 | 3/2008 | Fuh et al. |

FOREIGN PATENT DOCUMENTS

| | | | |
|---|---|---|---|
| EP | 0307434 | A1 | 3/1989 |
| EP | 0919619 | A2 | 6/1999 |
| EP | 1870459 | A1 | 12/2007 |
| WO | 9208796 | A1 | 5/1992 |
| WO | 9308829 | A1 | 5/1993 |
| WO | 9428143 | A1 | 12/1994 |
| WO | 9627011 | A1 | 9/1996 |
| WO | 9839352 | A1 | 9/1998 |
| WO | 9850431 | A2 | 11/1998 |
| WO | 9914226 | A2 | 3/1999 |
| WO | 0047599 | A1 | 8/2000 |
| WO | 0066604 | A2 | 11/2000 |
| WO | 0123613 | A1 | 4/2001 |
| WO | 0177342 | A1 | 10/2001 |
| WO | 2003089622 | A2 | 10/2003 |
| WO | 2004046160 | A2 | 6/2004 |
| WO | 2004065417 | A2 | 8/2004 |
| WO | 20040111194 | A2 | 12/2004 |
| WO | 2007031091 | A2 | 3/2007 |
| WO | 2007090071 | A2 | 8/2007 |
| WO | 2007110205 | A2 | 10/2007 |
| WO | 2007134181 | A2 | 11/2007 |
| WO | 2007147901 | A1 | 12/2007 |
| WO | 2008016356 | A2 | 2/2008 |
| WO | 2008024715 | A2 | 2/2008 |
| WO | 2008150729 | A2 | 12/2008 |
| WO | 2008154401 | A2 | 12/2008 |
| WO | 2009006478 | A2 | 1/2009 |
| WO | 2009067647 | A1 | 5/2009 |
| WO | 2009080251 | A1 | 7/2009 |
| WO | 2009080252 | A1 | 7/2009 |
| WO | 2009080253 | A1 | 7/2009 |
| WO | 2009080254 | A1 | 7/2009 |

(Continued)

OTHER PUBLICATIONS

Kaufman (2002) “Orchestrating the unfolded protein response in health and disease”, The Journal of Clinical Investigation, 110(10):1389-98. (Year: 2002).*
Yazaki et al., “Expression of Recombinant Antibodies in Mammalian Cell Lines”, Antibody Engineering of Methods in Molecular Biology Series, Humana Press, vol. 248, pp. pp. 255 - 268, 2004.
PCT/EP2021/086382 , “International Search Report and Written Opinion”, issued by the European Patent Office, as International Searching Authority on May 4, 2022, 12 pages.8, 2021, 10 pages.
Takao Iwawaki et al: “A transgenic mouse model for monitoring endoplasmic reticulum stress”, Nature Medicine, vol. 10, No. 1, pp. 98-102, Dec. 14, 2003.

(Continued)

*Primary Examiner* — Robert M Kelly
(74) *Attorney, Agent, or Firm* — Kilpatrick Townsend & Stockton LLP

(57) ABSTRACT

The invention relates to antisense oligonucleotides which alter the splicing of XBP1 pre-mRNA. The antisense oligonucleotides have applications in enhancing the level and/or quality of protein expression in cells and in mammalian protein expression systems, such as heterologous protein expression systems, such as enhancing antibody expression in CHO cells. The antisense oligonucleotides also have applications in therapy, such as for the treatment or prevention of proteopathological diseases.

16 Claims, 12 Drawing Sheets

Specification includes a Sequence Listing.

(56) References Cited

FOREIGN PATENT DOCUMENTS

| | | | |
|---|---|---|---|
| WO | 2009089004 | A1 | 7/2009 |
| WO | 2010008860 | A1 | 1/2010 |
| WO | 2010036698 | A1 | 4/2010 |
| WO | 2010077578 | A1 | 7/2010 |
| WO | 2010112193 | A1 | 10/2010 |
| WO | 2010115589 | A1 | 10/2010 |
| WO | 2010129304 | A2 | 11/2010 |
| WO | 2010136172 | A1 | 12/2010 |
| WO | 2010145792 | A1 | 12/2010 |
| WO | 2010145793 | A1 | 12/2010 |
| WO | 2011005786 | A2 | 1/2011 |
| WO | 2011017521 | A2 | 2/2011 |
| WO | 2011090754 | A1 | 7/2011 |
| WO | 2011143545 | A1 | 11/2011 |
| WO | 2011156202 | A1 | 12/2011 |
| WO | 2012058768 | A1 | 5/2012 |
| WO | 2012163520 | A1 | 12/2012 |
| WO | 2013026831 | A1 | 2/2013 |
| WO | 2013096291 | A2 | 6/2013 |
| WO | 2013154798 | A1 | 10/2013 |
| WO | 2013157954 | A1 | 10/2013 |
| WO | 2014076195 | A1 | 5/2014 |
| WO | 2015095539 | A1 | 6/2015 |
| WO | 2015113922 | A1 | 8/2015 |
| WO | 2015150447 | A1 | 10/2015 |
| WO | 2016016299 | A1 | 2/2016 |
| WO | 2016172485 | A2 | 10/2016 |
| WO | 2017055540 | A1 | 4/2017 |
| WO | 2017157899 | A1 | 9/2017 |
| WO | 2019004939 | A1 | 1/2019 |
| WO | 2020157700 | A1 | 8/2020 |

OTHER PUBLICATIONS

Klimenko Oxana V. et al: "The full recovery of mice (Mus Musculus C57BL/6 strain) from virus-induced sarcoma after treatment with a complex of DDMC delivery system and sncRNAs", Non-Coding RNA Research, vol. 4, No. 2, pp. 69-78, Jun. 1, 2019.

Database UniPARC, "UPI000228A8AF," XP002803349, abstract; sequence UPI000228A8AF, 1 page, Aug. 25, 2011.

Atwell, et al., "Stable Heterodimers from Remodeling the Domain Interface of a Homodimer Using a Phage Display Library", Journal of Molecular Biology, vol. 270, No. 1, Jul. 4, 1997, pp. 26-35.

Brennan, et al., "Preparation of Bispecific Antibodies by Chemical Recombination of Monoclonal Immunoglobulin G1 Fragments", Science, vol. 229, No. 4708, Jul. 5, 1985, pp. 81-83.

Brunhouse, et al., "Isotypes of IgG: Comparison of the Primary Structures of Three Pairs of Isotypes Which Differ in their Ability to Activate Complement", Molecular Immunology, vol. 16, No. 11, Nov. 1979, pp. 907-917.

Burton, et al., "The C1q Receptor Site on Immunoglobulin G", Nature, vol. 288, Nov. 27, 1980, pp. 338-344.

Cain, et al., "A CHO Cell Line Engineered to Express XBP1 and ERO1-Lα has Increased Levels of Transient Protein Expression", Biotechnology Progress, vol. 29, No. 3, May-Jun. 2013, pp. 697-706.

Carter, et al., "Knobs-into-Holes' Provides a Rational Design Strategy for Engineering Antibody CH3 Domains for Heavy Chain Heterodimerization", Immunotechnology, vol. 2, No. 1, Feb. 1996, p. 73.

Caruthers, et al., "Chemical Synthesis of Deoxyoligonucleotides by the Phosphoramidite Method", Methods in Enzymology, vol. 154, Feb. 1987, pp. 287-313.

Chothia, et al., "Canonical Structures for the Hypervariable Regions of Immunoglobulins", Journal of Molecular Biology, vol. 196, No. 4, Aug. 20, 1987, pp. 901-917.

Deleavey, et al., "Designing Chemically Modified Oligonucleotides for Targeted Gene Silencing", Chemistry & Biology, vol. 19, No. 8, Aug. 24, 2012, pp. 937-954.

Flatman, et al., "Process Analytics for Purification of Monoclonal Antibodies", Journal of Chromatography B: Analytical Technologies in the Biomedical and Life Sciences, vol. 848, No. 1, Mar. 15, 2007, pp. 79-87.

Freier , et al., "The Ups and Downs of Nucleic Acid Duplex Stability: Structure-Stability Studies on Chemically-Modified DNA:RNA Duplexes", Nucleic Acids Research, vol. 25, No. 22, Nov. 15, 1997, pp. 4429-4443.

Graham, et al., "Characteristics of a Human Cell Line Transformed by DNA from Human Adenovirus Type 5", Journal of General Virology, vol. 36, No. 1, Jul. 1977, pp. 59-72.

Hansen, et al., "Entropy Titration. A Calorimetric Method for the Determination of $\Delta g°$ (K), $\Delta h°$ and $\Delta S°$ 1", Chemical Communications, No. 3, 1965, pp. 36-38.

Hezareh, et al., "Effector Function Activities of a Panel of Mutants of a Broadly Neutralizing Antibody Against Human Immunodeficiency Virus Type 1", Journal of Virology, the American Society for Microbiology, vol. 75, No. 24, Dec 1, 2001, p. 12161-12168.

Hirao, et al., "Natural versus Artificial Creation of Base Pairs in DNA: Origin of Nucleobases from the Perspectives of Unnatural Base Pair Studies", Accounts of Chemical Research, vol. 45, No. 12, Dec 18, 2012, pp. 2055-2065.

Holliger, et al., ""Diabodies": Small Bivalent and Bispecific Antibody Fragments", Proceedings of the National Academy of Sciences, vol. 90, No. 14, Jul. 15, 1993, pp. 6444-6448.

Idusogie, et al., "Mapping of the C1q Binding Site on Rituxan, a Chimeric Antibody With a Human IgG1 Fc", Journal of Immunology, vol. 164, No. 8, Apr. 15, 2000, pp. 4178-4184.

Klein, et al., "The Use of CrossMAb Technology for the Generation of bi- and Multispecific Antibodies", Monoclonal Antibody, vol. 8, No. 6, Jun. 10, 2016, pp. 1010-1020.

Kostelny, et al., "Formation of a Bispecific Antibody by the Use of Leucine Zippers", Journal of Immunology, vol. 148, No. 5, Mar. 1, 1992, pp. 1547-1553.

Langer, "New Methods of Drug Delivery", Science, New Series, vol. 249, No. 4976, Sep. 28, 1990, pp. 1527-1533.

Lanza, et al., "Using the Cre/Lox System for Targeted Integration into the Human Genome: LoxFAS-LoxP Pairing and Delayed Introduction of Cre DNA Improve Gene Swapping Efficiency", Biotechnology Journal, vol. 7, No. 7, Jul. 2012, pp. 898-908.

Lukas, et al., "Inhibition of C1-Mediated Immune Hemolysis by Monomeric and Dimeric Peptides from the Second Constant Domain of Human Immunoglobulin G", Journal of Immunology, vol. 127, No. 6, Dec 1981, pp. 2555-2560.

MacCallum, et al., "Antibody-Antigen Interactions: Contact Analysis and Binding Site Topography", Journal of Molecular Biology, vol. 262, No. 5, Oct. 11, 1996, pp. 732-745.

Manoharan, "Oligonucleotide Conjugates as Potential Antisense Drugs with Improved Uptake, Biodistribution, Targeted Delivery, and Mechanism of Action", Antisense and Nucleic Acid Drug Development, vol. 12, No. 2, Apr. 2002, pp. 103-128.

Mather, et al., "Culture of Testicular Cells in Hormone-Supplemented Serum-Free Medium", Annals of the New York Academy of Sciences, vol. 383, 1982, pp. 44-68.

Mather, "Establishment and Characterization of Two Distinct Mouse Testicular Epithelial Cell Lines", Biology of Reproduction, vol. 23, No. 1, Aug. 1980, pp. 243-252.

McTigue, et al., "Sequence-Dependent Thermodynamic Parameters for Locked Nucleic Acid (LNA)-DNA Duplex Formation", Biochemistry, vol. 43, No. 18, May 11, 2004, pp. 5388-5405.

Merchant, et al., "An Efficient Route to Human Bispecific IgG", Nature Biotechnology, vol. 16, No. 7, Jul. 1998, pp. 677-681.

Mergny, et al., "Analysis of Thermal Melting Curves", Oligonucleotides, vol. 13, No. 6, 2003, pp. 515-537.

Milstein, et al., "Hybrid Hybridomas and their Use in Immunohistochemistry", Nature, vol. 305, No. 6, Oct. 6, 1983, pp. 537-540.

Mitsuoka, et al., "A Bridged Nucleic Acid, 2',4'-BNA COC: Synthesis of Fully Modified Oligonucleotides Bearing Thymine, 5-Methylcytosine, Adenine and Guanine 2',4'-BNA Coc Monomers and RNA-Selective Nucleic-Acid Recognition", Nucleic Acids Research, vol. 37, No. 4, Mar. 2009, pp. 1225-1238.

Morgan, et al., "The N-terminal end of the CH2 domain of chimeric human IgG1 anti-HLA-DR is necessary for C1q, Fc gammaR1 and Fc gamma RIII binding", Immunology, vol. 86, No. 2, 1995, pp. 319-324.

(56) References Cited

OTHER PUBLICATIONS

Morita , et al., "2'-O,4'-C-Ethylen-Bridged Nucleic Acids (ENA): Highly Nuclease-Resistant and Thermodynamically Stable Oligonucleotides for Antisense Drug", Bioorganic & Medicinal Chemistry Letters, vol. 12, No. 1, Jan. 7, 2002, pp. 73-76.
O'Gorman, et al., "Protamine-Cre Recombinase Transgenes Efficiently Recombine Target Sequences in the Male Germ Line of Mice, but not in Embryonic Stem Cells", Proceedings of the National Academy of Sciences of the United States of America, vol. 94, No. 26, Dec 23, 1997, pp. 14602-14607.
Pace, et al., "How to Measure and Predict the Molar Absorption Coefficient of a Protein", Protein Science, vol. 4, No. 11, Nov. 1995, pp. 2411-2423.
Ridgway, et al., "Knobs-Into-Holes Engineering of Antibody CH3 Domains for Heavy Chain Heterodimerization", Protein Engineering, vol. 9, No. 7, Jul. 1, 1996, pp. 617-621.
Santalucia, "A Unified View of Polymer, Dumbbell, and Oligonucleotide DNA Nearest-Neighbor Thermodynamics", Proceedings of the National Academy of Sciences of the United States of America, vol. 95, No. 4, Feb. 1998, pp. 1460-1465.
Schaefer, et al., "Immunoglobulin Domain Crossover as a Generic Approach for the Production of Bispecific IgG Antibodies", Proceedings of the National Academy of Sciences of the United States of America, vol. 108, No. 27, Jul. 5, 2011, pp. 11187-11192.
Seth, et al., "Synthesis and Biophysical Evaluation of 2',4'-Constrained 2'O-methoxyethyl and 2',4'-Constrained 2'O-ethyl Nucleic Acid Analogues", The Journal of Organic Chemistry, vol. 75, No. 5, Feb. 8, 2010, pp. 1569-1581.
Spiess, et al., "Alternative Molecular Formats and Therapeutic Applications for Bispecific Antibodies", Molecular Immunology, vol. 67, Oct. 2015, pp. 95-106.
Sugimoto, et al., "Thermodynamic Parameters to Predict Stability of RNA/DNA Hybrid Duplexes", Biochemistry, vol. 34, No. 35, Sep. 5, 1995, pp. 11211-11216.
Thommesen, et al., "Lysine 322 in the Human IgG3 CH2 Domain is Crucial for Antibody Dependent Complement Activation", Molecular Immunology, vol. 37, No. 6, Nov. 2000, pp. 995-1004.
Tong, et al., "XBP1 Depletion Precedes Ubiquitin Aggregation and Golgi Fragmentation in TDP-43 Transgenic Rats", Journal of Neurochemistry, vol. 123, No. 3, Nov. 2012, pp. 406-416.
Traunecker, et al., "Bispecific Single Chain Molecules (Janusins) Target Cytotoxic Lymphocytes on HIV Infected Cells", EMBO Journal, vol. 10, No. 12, Dec 1991, pp. 3655-3699.
Tutt, et al., "Trispecific F(ab')3 Derivatives that Use Cooperative Signaling via the TCR/CD3 Complex and CD2 to Activate and Redirect Resting Cytotoxic T Cells", Journal of Immunology, vol. 147, No. 1, Jul. 1, 1991, pp. 60-69.
Uhlmann, et al., "Recent Advances in the Medicinal Chemistry of Antisense Oligonucleotides", Current Opinion in Drug Development, vol. 3, No. 2, Mar. 2000, pp. 203-213.
Urlaub, et al., "Isolation of Chinese Hamster Cell Mutants Deficient in Dihydrofolate Reductase Activity", Proceedings of the National Academy of Sciences, vol. 77, No. 7, Jul. 1980, pp. 4216-4220.
Wan, et al., "The Medicinal Chemistry of Therapeutic Oligonucleotide", Journal of Medicinal Chemistry, vol. 59, No. 21, Jul. 19, 2016, pp. 9645-9667.
Wolfel, et al., "CAP-T Cell Expression System: A Novel Rapid and Versatile Human Cell Expression System for Fast and High Yield Transient Protein Expression", BMC Proceedings, vol. 5, Nov. 22, 2011, pp. 1-2.
Wong, et al., "Reproducible Doxycycline-Inducible Transgene Expression at Specific Loci Generated by Cre-Recombinase Mediated Cassette Exchange", Nucleic Acids Research, vol. 33, No. 17, Oct. 4, 2005, pp. 1-13.
Scharner et al., "Hybridization-mediated off-target effects of splice-switching antisense oligonucleotides," *Nucleic Acids Research*, vol. 48, No. 2, pp. 802-816 (2020), published online Dec 5, 2019, DOI: 10.1093/nar/gkz1132.

* cited by examiner

```
CLUSTAL O(1.2.4) multiple sequence alignment

NP_001230976  ARKRQRLTHLSPEEKALRRKLKNRVAAQTARDRKKARMSELEQQVVDLEEENQKLLLENQ   60
NP_001230978  ARKRQRLTHLSPEEKALRRKLKNRVAAQTARDRKKARMSELEQQVVDLEEENQKLLLENQ   60
XBP1D4        ARKRQRLTHLSPEEKALRRKLKNRVAAQTARDRKKARMSELEQQVVDLEEENQKLLLENQ   60
              ************************************************************

NP_001230976  LLREKTHGLVIENQELRTRLGMDVLTTEEAPETESKGNGVRPVAGSAESAALRLRAPLQQ  120
NP_001230978  LLREKTHGLVIENQELRTRLGMDVLTTEEAPETESKGNGVRPVAGSAESAAGAGPVVTSP  120
XBP1D4        LLREKTHGLVIENQELRTRLGMDVLTTEEAPETES-------------------------   95
              ***********************************

NP_001230976  VQ-----AQLSPPQNIFPWILTLLTLQTPSLISFWAFW--TSWTLSCFSNVH--PQSLPI  171
NP_001230978  EHLPMDSDTVDSSDSESDILLGILDKLDPV--MFFKCPSPESANLEELPEVYPGPSSLPA  178
XBP1D4        ---------------KSDILLGILDKLDPV--MFFKCPSPESANLEELPEVYPGPSSLPA  138
                                 :* :*    *    *:      * .*. : :*:  *.***

NP_001230976  WR----NS----QRSTQDLVPYQ----PPFLCQWGP----------------------HQ  197
NP_001230978  SLSLSVGTSSAKLEAINELIRFDHVYTKPLVLEIPSETESQTNVVVKIEEAPLSSSEEDH  238
XBP1D4        SLSLSVGTSSAKLEAINELIRFDHVYTKPLVLEIPSETESQTNVVVKIEEAPLSSSEEDH  198
                    .:     .: ::*: ::     *:: :                         .:

NP_001230976  PSW------KPLMNSFAL--------------------------TMYTPSL---------  216
NP_001230978  PEFIVSVKKEPLEEDFIPEPGISNLLSSSHCLKPSSCLLDAYSDCGYEGSPSPFSDMSSP  298
XBP1D4        PEFIVSVKKEPLEEDFIPEPGISNLLSSSHCLKPSSCLLDAYSDCGYEGSPSPFSDMSSP  258
              *.:      :** :.*                              *  *

NP_001230976  ----------------------       216
NP_001230978  LGIDHSWEDTFANELFPQLISV       320
XBP1D4        LGIDHSWEDTFANELFPQLISV       280
```

FIG. 4

```
XBP1s_Hamster    MVVVAASPSAATAAPKVLLLSGQPAADG-----RALPLMVPGSRAAGSEANG--APQARK
XBP1s_Mouse      MVVVAAAPSAATAAPKVLLLSGQPASGG-----RALPLMVPGPRAAGSEASG--TPQARK
XBP1s_Human      MVVVAAAPNPADGTPKVLLLSGQPASAAGAPAGQALPLMVPAQRGASPEAASGGLPQARK
                 ******:*..*  .:***********:  .     :*******. *.*..**  .   *****

XBP1s_Hamster    RQRLTHLSPEEKALRRKLKNRVAAQTARDRKKARMSELEQQVVDLEEENQKLLLENQLLR
XBP1s_Mouse      RQRLTHLSPEEKALRRKLKNRVAAQTARDRKKARMSELEQQVVDLEEENHKLQLENQLLR
XBP1s_Human      RQRLTHLSPEEKALRRKLKNRVAAQTARDRKKARMSELEQQVVDLEEENQKLLLENQLLR
                 *************************************************:** *******

XBP1s_Hamster    EKTHGLVIENQELRTRLGMDVLTTEEAPETESKGNGVRPVAGSAESAAGAGPVVTSPEHL
XBP1s_Mouse      EKTHGLVVENQELRTRLGMDTLDPDEVPEVEAKGSGVRLVAGSAESAAGAGPVVTSPEHL
XBP1s_Human      EKTHGLVVENQELRQRLGMDALVAEEEAEAK--GNEVRPVAGSAESAAGAGPVVTPPEHL
                 *******:****** *****.*  .:*  .*.:   *. ** ***************.****

XBP1s_Hamster    PMDSDTVDSSDSESDILLGILDKLDPVMFFKCPSPESANLEELPEVYP-GPSSLPASLSL
XBP1s_Mouse      PMDSDTVASSDSESDILLGILDKLDPVMFFKCPSPESASLEELPEVYPEGPSSLPASLSL
XBP1s_Human      PMDSGGIDSSDSESDILLGILDNLDPVMFFKCPSPEPASLEELPEVYPEGPSSLPASLSL
                 ****.  :  *************:************.*.********* ***********

XBP1s_Hamster    SVGTSSAKLEAINELIRFDHVYTKPLVLEIPSETESQTNVVVKIEEAPLSSSEEDHPEFI
XBP1s_Mouse      SVGTSSAKLEAINELIRFDHVYTKPLVLEIPSETESQTNVVVKIEEAPLSSSEEDHPEFI
XBP1s_Human      SVGTSSAKLEAINELIRFDHIYTKPLVLEIPSETESQANVVVKIEEAPLSPSENDHPEFI
                 ********************:****************:************.**:******

XBP1s_Hamster    VSVKKEPLEEDFIPEPGISNLLSSSHCLKPSSCLLDAYSDCGYEGSPSPFSDMSSPLGID
XBP1s_Mouse      VSVKKEPLEDDFIPELGISNLLSSSHCLRPPSCLLDAHSDCGYEGSPSPFSDMSSPLGTD
XBP1s_Human      VSVKEEPVEDDLVPELGISNLLSSSHCPKPSSCLLDAYSDCGYGGSLSPFSDMSSLLGVN
                 ****:**:*:*:.:** *********** :*.*****:***** ** ******* ** :

XBP1s_Hamster    HSWEDTFANELFPQLISV
XBP1s_Mouse      HSWEDTFANELFPQLISV
XBP1s_Human      HSWEDTFANELFPQLISV
                 ******************
```

FIG. 9

```
Delta4_XBP1_Hamster    MVVVAAAPSAATAAPKVLLLSGQPAADG-----RALPLMVPGSRAAGSEANG--APQARK
Delta4_XBP1_Mouse      MVVVAAAPSAATAAPKVLLLSGQPASGG-----RALPLMVPGPRAAGSEASG--TPQARK
Delta4_XBP1_Human      MVVVAAAPNPADGTPKVLLLSGQPASAAGAPAGQALPLMVPAQRGASPEAASGGLPQARK
                       ********..* .:***********: .     :*******. *.*..** .   *****

Delta4_XBP1_Hamster    RQRLTHLSPEEKALRRKLKNRVAAQTARDRKKARMSELEQQVVDLEEENQKLLLENQLLR
Delta4_XBP1_Mouse      RQRLTHLSPEEKALRRKLKNRVAAQTARDRKKARMSELEQQVVDLEEENHKLQLENQLLR
Delta4_XBP1_Human      RQRLTHLSPEEKALRRKLKNRVAAQTARDRKKARMSELEQQVVDLEEENQKLLLENQLLR
                       *************************************************:** *******

Delta4_XBP1_Hamster    EKTHGLVIENQELRTRLGMDVLTTEEAPETESKSDILLGILDKLDPVMFFKCPSPESANL
Delta4_XBP1_Mouse      EKTHGLVVENQELRTRLGMDTLDPDEVPEVEAKSDILLGILDKLDPVMFFKCPSPESASL
Delta4_XBP1_Human      EKTHGLVVENQELRQRLGMDALVAEEEAEAK--SDILLGILDNLDPVMFFKCPSPEPASL
                       *******:****** *****.* .:*  .*.:  *********:*************.*.*

Delta4_XBP1_Hamster    EELPEVYP-GPSSLPASLSLSVGTSSAKLEAINELIRFDHVYTKPLVLEIPSETESQTNV
Delta4_XBP1_Mouse      EELPEVYPEGPSSLPASLSLSVGTSSAKLEAINELIRFDHVYTKPLVLEIPSETESQTNV
Delta4_XBP1_Human      EELPEVYPEGPSSLPASLSLSVGTSSAKLEAINELIRFDHIYTKPLVLEIPSETESQANV
                       ******** *******************************:****************.**

Delta4_XBP1_Hamster    VVKIEEAPLSSSEEDHPEFIVSVKKEPLEEDFIPEPGISNLLSSSHCLKPSSCLLDAYSD
Delta4_XBP1_Mouse      VVKIEEAPLSSSEEDHPEFIVSVKKEPLEDDFIPELGISNLLSSSHCLRPPSCLLDAHSD
Delta4_XBP1_Human      VVKIEEAPLSPSENDHPEFIVSVKEEPVEDDLVPELGISNLLSSSHCPKPSSCLLDAYSD
                       **********.**:**********:**:*:*::** *********** :*.******:**

Delta4_XBP1_Hamster    CGYEGSPSPFSDMSSPLGIDHSWEDTFANELFPQLISV
Delta4_XBP1_Mouse      CGYEGSPSPFSDMSSPLGTDHSWEDTFANELFPQLISV
Delta4_XBP1_Human      CGYGGSLSPFSDMSSLLGVNHSWEDTFANELFPQLISV
```

FIG. 10

```
Human_XBP1s     MVVVAAAPNPADGTPKVLLLSGQPASAAGAPAGQALPLMVPAQRGASPEAASGGLPQARK
Human_XBP1d4    MVVVAAAPNPADGTPKVLLLSGQPASAAGAPAGQALPLMVPAQRGASPEAASGGLPQARK
                ************************************************************

Human_XBP1s     RQRLTHLSPEEKALRRKLKNRVAAQTARDRKKARMSELEQQVVDLEEENQKLLLENQLLR
Human_XBP1d4    RQRLTHLSPEEKALRRKLKNRVAAQTARDRKKARMSELEQQVVDLEEENQKLLLENQLLR
                ************************************************************

Human_XBP1s     EKTHGLVVENQELRQRLGMDALVAEEEAEAKGNEVRPVAGSAESAAGAGPVVTPPEHLPM
Human_XBP1d4    EKTHGLVVENQELRQRLGMDALVAEEEAEAK-----------------------------
                *******************************

Human_XBP1s     DSGGIDSSDSESDILLGILDNLDPVMFFKCPSPEPASLEELPEVYPEGPSSLPASLSLSV
Human_XBP1d4    -----------SDILLGILDNLDPVMFFKCPSPEPASLEELPEVYPEGPSSLPASLSLSV
                           *************************************************

Human_XBP1s     GTSSAKLEAINELIRFDHIYTKPLVLEIPSETESQANVVVKIEEAPLSPSENDHPEFIVS
Human_XBP1d4    GTSSAKLEAINELIRFDHIYTKPLVLEIPSETESQANVVVKIEEAPLSPSENDHPEFIVS
                ************************************************************

Human_XBP1s     VKEEPVEDDLVPELGISNLLSSSHCPKPSSCLLDAYSDCGYGGSLSPFSDMSSLLGVNHS
Human_XBP1d4    VKEEPVEDDLVPELGISNLLSSSHCPKPSSCLLDAYSDCGYGGSLSPFSDMSSLLGVNHS
                ************************************************************

Human_XBP1s     WEDTFANELFPQLISV
Human_XBP1d4    WEDTFANELFPQLISV
                ****************
```

FIG. 11

OLIGONUCLEOTIDES TARGETING XBP1

CROSS-REFERENCE TO RELATED APPLICATIONS

The present application is a continuation of International Application No. PCT/EP2021/086382, filed on Dec. 17, 2021, which claims the benefit of and the priority to European Patent Application No. 20216690.6, filed on Dec. 22, 2020, the entire contents of which are herein incorporated by reference in their entireties for all purposes.

REFERENCE TO AN ELECTRONIC SEQUENCE LISTING

A Sequence Listing conforming to the rules of WIPO Standard ST.26 is hereby incorporated by reference. Said Sequence Listing has been filed as an electronic document via PatentCenter encoded as XML in UTF-8 text. The electronic document, created on Jun. 22, 2023, is entitled "105703-1389885-P36582-US_ST26.xml", and is 8,699,236 bytes in size.

FIELD OF THE INVENTION

The present invention relates to oligonucleotides which induce expression of an XBP1 splice variant. Such oligonucleotides can enhance the level and/or quality of protein expression in cells and have utility in mammalian protein expression systems, such as heterologous protein expression systems. The oligonucleotides also have therapeutic utilities including the treatment or prevention of proteopathological diseases.

BACKGROUND

XBP1, X-box binding protein 1, is a transcription factor which mediates adaptation to ER stress by inducing genes that are involved in protein folding and quality control.

The XBP1 transcript exists in different splice forms, including a splice variant whose expression is regulated by IRE1a (inositol requiring-enzyme 1 alpha). In mammalian cells, IRE1a excises a 26 nucleotide fragment from the XBP1 mRNA under endoplasmic reticulum (ER) stress to generate a splice variant that encodes the functionally active XBP1s protein.

The excision of the 26 nucleotide fragment results in a +2 out of frame event, resulting in the expression of the active XBP1 transcription factor (XBP-1S). The 26 nucleotide fragment is present in exon 4 of XBP1 mature mRNA.

Cain et al., (Biotechnol Prog 2013; 29 (3): 697-706) reports on Chinese hamster ovary (CHO) cells engineered to express both X-box binding protein (XBP-1S) and endoplasmic reticulum oxidoreductase (ERO1-Lα) (CHOS-XE. CHOS-XE cells) which provide increased antibody yields (5.3-6.2 fold) in comparison to CHOS cells.

Tong et al., (Neurochem. 2012 November; 123 (3): 406-416), reports on the over-expression of mutant TDP-43 in transgenic rats, which resulted in prominent aggregation of ubiquitin and loss of fragmentation of Golgi complexes, prior to neuronal loss. Notably the aggregation of ubiquitin and loss of fragmentation of Golgi complexes was further preceded by depletion of XBP1 and inactivation of the unfolded protein response (UPR) This indicates that there is a need for restoring or up-regulating the XBP1 mediated UPR in diseases associated with aberrant protein folding (proteopathological diseases), such as neurodegenerative diseases, including TDP-43 pathologies, e.g. frontotemporal lobar degeneration (FTLD) and ALS.

In WO 2003/89622 novel genes, compositions, and methods for modulating the unfolded protein response are disclosed.

In WO 2019/004939 antisense oligonucleotides for modulating the function of a t cell are disclosed.

In WO 2008/016356 the genemap of the human genes associated with psoriasis is disclosed.

OBJECT OF THE INVENTION

The inventors have surprisingly determined that an active XBP1 splice variant has applications in methods of protein production as well as in therapeutic methods, primarily relating to the treatment of proteopathological diseases.

The inventors have surprisingly determined that an active XBP1 spice variant can be produced using an antisense oligonucleotide which is complementary, such as fully complementary, to a portion of the XBP1 pre-mRNA transcript. This XPB1 splice variant may be an XBP144 splice variant (XBP1 splice variant with deleted exon 4). XBP1 exon 4 comprises the 26 nucleotide fragment which is excised by IRE1a in vivo, and as with the in vivo IRE1α 26 nucleotide excision event, the skipping of exon 4 introduces a +2 out of frame event.

The current invention is based, at least in part, on the finding that the generation or expression of the XBP144 variant in recombinant mammalian cells results in an enhanced expression of heterologously expressed proteins, such as monoclonal antibodies, particularly heterologously expressed proteins which are otherwise difficult to express. With the expression of the XBP144 variant, protein expression with enhanced quality in mammalian cells can be obtained.

The current invention is based, at least in part, on the finding that compounds, such as antisense oligonucleotides, which induce the generation or expression of XBP144 in mammalian cells, are useful in enhancing the recombinant expression of heterologously expressed proteins in mammalian cells. In particular, compounds, such as antisense oligonucleotides, which induce the expression of XBP144 in mammalian cells, are useful in enhancing the recombinant expression of correctly folded heterologously expressed proteins in mammalian cells.

The current invention is based, at least in part, on the finding that antisense oligonucleotides which induce the expression of XBP144 in mammalian cells are useful for the treatment of proteopathological diseases.

SUMMARY OF THE INVENTION

According to one aspect, the invention provides an antisense oligonucleotide for use in the generation or expression of a XBP1 splice variant in a cell which expresses XBP1, wherein the antisense oligonucleotide is 8-40 nucleotides in length and comprises a contiguous nucleotide sequence of 8-40 nucleotides in length which is complementary to a mammalian XBP1 pre-mRNA transcript.

The XBP1 splice variant may be a XBP144 variant.

The contiguous nucleotide sequence may be complementary to at least 10 contiguous nucleotides of the hamster XBP1 pre-mRNA transcript (SEQ ID NO 1), such as at least 10 contiguous nucleotides from nucleotides 2960-3113 of SEQ ID NO 1 or at least 10 contiguous nucleotides from nucleotides 2986-3018 of SEQ ID NO 1.

The contiguous nucleotide sequence may be complementary to a sequence selected from the group consisting of SEQ ID NO 299, SEQ ID NO 301, SEQ ID NO 302, SEQ ID NO 304, SEQ ID NO 305, SEQ ID NO 306, SEQ ID NO 307, SEQ ID NO 308, SEQ ID NO 309, SEQ ID NO 310, SEQ ID NO 314, SEQ ID NO 316, SEQ ID NO 317, SEQ ID NO 318, SEQ ID NO 319, SEQ ID NO 323, SEQ ID NO 325, SEQ ID NO 327, SEQ ID NO 328, SEQ ID NO 330, SEQ ID NO 331, SEQ ID NO 332, SEQ ID NO 333, SEQ ID NO 334, SEQ ID NO 336, SEQ ID NO 337, SEQ ID NO 385, SEQ ID NO 386, SEQ ID NO 387, SEQ ID NO 388, SEQ ID NO 390, SEQ ID NO 391, SEQ ID NO 392, SEQ ID NO 393, SEQ ID NO 394, SEQ ID NO 395, SEQ ID NO 396 397, SEQ ID NO 398, SEQ ID NO 399, SEQ ID NO 401, SEQ ID NO 402, SEQ ID NO 419, SEQ ID NO 431, SEQ ID NO, SEQ ID NO 432, SEQ ID NO 433, SEQ ID NO 434, SEQ ID NO 438, SEQ ID NO 439, SEQ ID NO 440, SEQ ID NO 441, SEQ ID NO 442, SEQ ID NO 449, SEQ ID NO 484, SEQ ID NO 485, SEQ ID NO 486, SEQ ID NO 487, SEQ ID NO 488, SEQ ID NO 489, SEQ ID NO 490, SEQ ID NO 491, SEQ ID NO 492, SEQ ID NO 493, SEQ ID NO 494, SEQ ID NO 495, SEQ ID NO 496, SEQ ID NO 497, SEQ ID NO 498, SEQ ID NO 499, SEQ ID NO 500, SEQ ID NO 501, SEQ ID NO 502, SEQ ID NO 503, SEQ ID NO 505, SEQ ID NO 506, SEQ ID NO 507, SEQ ID NO 508, SEQ ID NO 509, SEQ ID NO 510, SEQ ID NO 511, SEQ ID NO 512, SEQ ID NO 513, SEQ ID NO 515, SEQ ID NO 517, SEQ ID NO 520, SEQ ID NO 572, SEQ ID NO 573, SEQ ID NO 576, SEQ ID NO 577, SEQ ID NO 588 and SEQ ID NO 589.

The contiguous nucleotide sequence may be selected from the group consisting of SEQ ID NO 8, SEQ ID NO 10, SEQ ID NO 11, SEQ ID NO 13, SEQ ID NO 14, SEQ ID NO 15, SEQ ID NO 16, SEQ ID NO 17, SEQ ID NO 18, SEQ ID NO 19, SEQ ID NO 23, SEQ ID NO 24, SEQ ID NO 25, SEQ ID NO 26, SEQ ID NO 27, SEQ ID NO 28, SEQ ID NO 32, SEQ ID NO 34, SEQ ID NO 36, SEQ ID NO 37, SEQ ID NO 39, SEQ ID NO 40, SEQ ID NO 41, SEQ ID NO 42, SEQ ID NO 43, SEQ ID NO 45, SEQ ID NO 46, SEQ ID NO 94, SEQ ID NO 95, SEQ ID NO 96, SEQ ID NO 97, SEQ ID NO 99, SEQ ID NO 100, SEQ ID NO 101, SEQ ID NO 102, SEQ ID NO 103, SEQ ID NO 104, SEQ ID NO 105, SEQ ID NO 106, SEQ ID NO 107, SEQ ID NO 108, SEQ ID NO 110, SEQ ID NO 111, SEQ ID NO 128, SEQ ID NO 140, SEQ ID NO 141, SEQ ID NO 142, SEQ ID NO 143, SEQ ID NO 147, SEQ ID NO 148, SEQ ID NO 149, SEQ ID NO 150, SEQ ID NO 151, SEQ ID NO 158, SEQ ID NO 193, SEQ ID NO 194, SEQ ID NO 195, SEQ ID NO 196, SEQ ID NO 197, SEQ ID NO 198, SEQ ID NO 199, SEQ ID NO 200, SEQ ID NO 201, SEQ ID NO 202, SEQ ID NO 203, SEQ ID NO 204, SEQ ID NO 205, SEQ ID NO 206, SEQ ID NO 207, SEQ ID NO 208, SEQ ID NO 209, SEQ ID NO 210, SEQ ID NO 211, SEQ ID NO 212, SEQ ID NO 214, SEQ ID NO 215, SEQ ID NO 216, SEQ ID NO 217, SEQ ID NO 218, SEQ ID NO 219, SEQ ID NO 220, SEQ ID NO 221, SEQ ID NO 222, SEQ ID NO 224; SEQ ID NO 226, SEQ ID NO 229, SEQ ID NO 281, SEQ ID NO 282, SEQ ID NO 285, SEQ ID NO 286, SEQ ID NO 297 and SEQ ID NO 298.

The contiguous nucleotide sequence may be complementary to at least 10 contiguous nucleotides of the mouse XBP1 pre-mRNA transcript (SEQ ID NO 590).

The contiguous nucleotide sequence may be complementary to a sequence selected from the group consisting of SEQ ID NO 699, SEQ ID NO 700, SEQ ID NO 703, SEQ ID NO 710, SEQ ID NO 713, SEQ ID NO 724, SEQ ID NO 729, SEQ ID NO 739, SEQ ID NO 743, SEQ ID NO 744, SEQ ID NO 745, SEQ ID NO 749, SEQ ID NO 750, SEQ ID NO 751, SEQ ID NO 752, SEQ ID NO 753, SEQ ID NO 754, SEQ ID NO 755, SEQ ID NO 756, SEQ ID NO 757, SEQ ID NO 758, SEQ ID NO 759, SEQ ID NO 760, SEQ ID NO 761, SEQ ID NO 762, SEQ ID NO 763, SEQ ID NO 773, SEQ ID NO 776, SEQ ID NO 778, SEQ ID NO 781, SEQ ID NO 783, SEQ ID NO 784, SEQ ID NO 785, SEQ ID NO 787, SEQ ID NO 789, SEQ ID NO 790, SEQ ID NO 791, SEQ ID NO 792, SEQ ID NO 793, SEQ ID NO 794, SEQ ID NO 795, SEQ ID NO 796, SEQ ID NO 797, SEQ ID NO 798, SEQ ID NO 799 and SEQ ID NO 800.

The contiguous nucleotide sequence may be selected from the group consisting of SEQ ID NO 597, SEQ ID NO 598, SEQ ID NO 601, SEQ ID NO 608, SEQ ID NO 611, SEQ ID NO 622, SEQ ID NO 627, SEQ ID NO 637, SEQ ID NO 641, SEQ ID NO 642, SEQ ID NO 643, SEQ ID NO 647, SEQ ID NO 648, SEQ ID NO 649, SEQ ID NO 650, SEQ ID NO 651, SEQ ID NO 652, SEQ ID NO 653, SEQ ID NO 654, SEQ ID NO 655, SEQ ID NO 656, SEQ ID NO 657, SEQ ID NO 658, SEQ ID NO 659, SEQ ID NO 660, SEQ ID NO 661, SEQ ID NO 671, SEQ ID NO 674, SEQ ID NO 676, SEQ ID NO 679, SEQ ID NO 681, SEQ ID NO 682, SEQ ID NO 683, SEQ ID NO 685, SEQ ID NO 687, SEQ ID NO 688, SEQ ID NO 689, SEQ ID NO 690, SEQ ID NO 691, SEQ ID NO 692, SEQ ID NO 693, SEQ ID NO 694, SEQ ID NO 695, SEQ ID NO 696, SEQ ID NO 697 and SEQ ID NO 697.

The contiguous nucleotide sequence may be complementary to at least 10 contiguous nucleotides of the human XBP1 pre-mRNA transcript (SEQ ID NO 801).

The contiguous nucleotide sequence may be complementary to a sequence selected from the group consisting of SEQ ID NO 947, SEQ ID NO 948, SEQ ID NO 949, SEQ ID NO 950, SEQ ID NO 951 and SEQ ID NO 988.

The contiguous nucleotide sequence may be selected from the group consisting of SEQ ID NO 854, SEQ ID NO 855, SEQ ID NO 856, SEQ ID NO 857, SEQ ID NO 858 and SEQ ID NO 895.

The antisense oligonucleotide or contiguous nucleotide sequence thereof may be fully complementary to a mammalian XBP1 pre-mRNA transcript.

The contiguous nucleotide sequence may be the same length as the antisense oligonucleotide.

The antisense oligonucleotide may be isolated, purified or manufactured.

The antisense oligonucleotide or contiguous nucleotide sequence thereof may comprise one or more modified nucleotides or one or more modified nucleosides.

The antisense oligonucleotide or contiguous nucleotide sequence thereof may be or comprises an antisense oligonucleotide mixmer or totalmer.

The invention includes conjugates and pharmaceutically acceptable salts of the antisense oligonucleotides of the invention as well as compositions and pharmaceutical compositions comprising the antisense oligonucleotides of the invention.

In another aspect, the invention provides an isolated XBP1Δ4 protein.

The isolated XBP1Δ4 protein of the invention may comprise the sequence of SEQ ID NO: 7, SEQ ID NO: 596 or SEQ ID NO 807.

In another aspect, the invention provides an isolated mRNA encoding the XBP1Δ4 protein of the invention.

The isolated mRNA of the invention may comprise the sequence of SEQ ID NO: 7, SEQ ID NO: 595 or SEQ ID NO: 806.

In another aspect, the invention provides a method for producing a polypeptide comprising the steps of:

a) cultivating a mammalian cell, which is expressing XBP1 and which comprises one or more nucleic acids encoding the polypeptide; and b) recovering the polypeptide from the cells or the cultivation medium;

characterized in that the cultivating is in the presence of an antisense oligonucleotide, a composition, a pharmaceutical composition, a protein or an mRNA of the invention.

Within the invention, the method may comprise the steps of:

a1) propagating a mammalian cell, which is expressing XBP1 and which comprises one or more nucleic acids encoding the polypeptide, in a cultivation medium comprising an antisense oligonucleotide according to the invention, to obtain a first cell population;

a2) mixing an aliquot of the first cell population with cultivation medium optionally comprising the antisense oligonucleotide to obtain a second cell population;

a3) cultivating the second cell population to obtain a third cell population; and b) recovering the polypeptide from the cells and/or the cultivation medium of the third cell cultivation.

Within the method of the invention, the antisense oligonucleotide may be added to a final concentration of 25 UM or more.

Within the method of the invention the cells resulting in the first cell population may be cultivated at a starting cell density of 0.5*10E6 to 4*10E6 cells/mL.

Within the method of the invention, the second cell population may have a cell density of 0.5*10E6 to 10*10E6 cells/mL.

Within the method of the invention, the mammalian cell may be a CHO cell.

Within the method of the invention, the polypeptide may be an antibody.

One aspect of the invention is a method for the recombinant production of a multimeric polypeptide comprising the steps of:

a) cultivating a mammalian cell, which comprises one or more nucleic acids encoding the multimeric polypeptide and which is expressing XBP1, in the presence of a nucleic acid according to the invention, which is inducing the formation of an XBP1 variant, in one preferred embodiment the XBP1 variant is XBP1Δ4; and b) recovering the multimeric polypeptide from the cells or the cultivation medium.

One further aspect of the invention is a method for the recombinant production of a multimeric polypeptide comprising the steps of:

a) cultivating a mammalian cell, which comprises one or more nucleic acids encoding the multimeric polypeptide and which is expressing XBP1, in the presence of a nucleic acid according to the invention, which is inducing the skipping of exon 4 in XBP1 mRNA, whereby a +2 out of frame event is introduced; and b) recovering the multimeric polypeptide from the cells or the cultivation medium.

In certain embodiments of all aspects and embodiments of the method for the recombinant production of a multimeric polypeptide, the method comprises the steps of:

a1) propagating a mammalian cell, which is expressing XBP1 and which comprises one or more nucleic acids encoding the polypeptide, in a cultivation medium comprising a nucleic acid according to the invention, which is inducing the formation of an XBP1 variant, in one preferred embodiment the XBP1 variant is XBP1Δ4, to obtain a first cell population;

a2) mixing an aliquot of the first cell population with cultivation medium optionally comprising the same or a different nucleic acid according to the invention, which is inducing the formation of the XBP1 variant XBP1Δ4, to obtain a second cell population;

a3) cultivating the second cell population to obtain a third cell population; and b) recovering the multimeric polypeptide from the cells and/or the cultivation medium of the third cell cultivation.

In certain embodiments of all aspects and embodiments of the method for the recombinant production of a multimeric polypeptide, the method comprises the steps of:

a1) propagating a mammalian cell, which is expressing XBP1 and which comprises one or more nucleic acids encoding the polypeptide, in a cultivation medium comprising a nucleic acid according to the invention, which is inducing the skipping of exon 4 in XBP1 mRNA, whereby a +2 out of frame event is introduced, to obtain a first cell population;

a2) mixing an aliquot of the first cell population with cultivation medium optionally comprising the same or a different nucleic acid according to the invention, which is inducing the skipping of exon 4 in XBP1 mRNA, whereby a +2 out of frame event is introduced, to obtain a second cell population;

a3) cultivating the second cell population to obtain a third cell population; and b) recovering the multimeric polypeptide from the cells and/or the cultivation medium of the third cell cultivation.

In certain embodiments of all aspects and embodiments of the method for the recombinant production of a multimeric polypeptide, the nucleic acid according to the invention is an antisense oligonucleotide.

In certain embodiments of all aspects and embodiments of the method for the recombinant production of a multimeric polypeptide, the nucleic acid according to the invention is complementary to at least 10 contiguous nucleotides of the hamster XBP1 pre-mRNA transcript (SEQ ID NO 1), such as at least 10 contiguous nucleotides from nucleotides 2960-3113 of SEQ ID NO 1 or at least 10 contiguous nucleotides from nucleotides 2986-3018 of SEQ ID NO 1.

In certain embodiments of all aspects and embodiments of the method for the recombinant production of a multimeric polypeptide, the nucleic acid according to the invention is complementary to at least 10 contiguous nucleotides of the human XBP1 pre-mRNA transcript (SEQ ID NO 801).

In certain embodiments of all aspects and embodiments of the method for the recombinant production of a multimeric polypeptide, the nucleic acid according to the invention is complementary to a sequence selected from the group consisting of SEQ ID NO 23 or SEQ ID NO 24.

In certain embodiments of all aspects and embodiments of the method for the recombinant production of a multimeric polypeptide, the nucleic acid according to the invention is complementary to a sequence selected from the group consisting of SEQ ID NO 947, SEQ ID NO 948, SEQ ID NO 949, SEQ ID NO 950, SEQ ID NO 951 and SEQ ID NO 988.

In certain embodiments of all aspects and embodiments of the method for the recombinant production of a multimeric polypeptide, the nucleic acid according to the invention is selected from the group consisting of SEQ ID NO 854, SEQ ID NO 855, SEQ ID NO 856, SEQ ID NO 857, SEQ ID NO 858 and SEQ ID NO 895.

In certain embodiments of all aspects and embodiments of the method for the recombinant production of a multimeric polypeptide, the XBP1 variant comprises the sequence of SEQ ID NO: 7, SEQ ID NO: 596 or SEQ ID NO 807.

In certain embodiments of all aspects and embodiments of the method for the recombinant production of a multimeric polypeptide, the XBP1 variant is encoded by the sequence of SEQ ID NO: 7, SEQ ID NO: 595 or SEQ ID NO: 806.

In certain embodiments of all aspects and embodiments of the method for the recombinant production of a multimeric polypeptide, the nucleic acid according to the invention is be added to a final concentration of 25 UM or more.

In certain embodiments of all aspects and embodiments of the method for the recombinant production of a multimeric polypeptide, the cells resulting in the first cell population are cultivated with a starting cell density of 0.5*10E6 to 4*10E6 cells/mL.

In certain embodiments of all aspects and embodiments of the method for the recombinant production of a multimeric polypeptide, the second cell population has a starting cell density of 0.5*10E6 to 10*10E6 cells/mL.

In certain embodiments of all aspects and embodiments of the method for the recombinant production of a multimeric polypeptide, the mammalian cell is a CHO cell.

In certain embodiments of all aspects and embodiments of the method for the recombinant production of a multimeric polypeptide, the mammalian cell is a HEK cell.

In certain embodiments of all aspects and embodiments of the method for the recombinant production of a multimeric polypeptide, the mammalian cell is a SP2/0 cell.

In certain embodiments of all aspects and embodiments of the method for the recombinant production of a multimeric polypeptide, the multimeric polypeptide is an antibody. In certain embodiments, the antibody is a bispecific antibody. In certain embodiments, the bispecific antibody is a full-length antibody with domain exchange or an antibody-multimer-fusion. In certain embodiments, the bispecific antibody is a trivalent, bispecific antibody. In certain embodiments, the bispecific, trivalent antibody is a full-length antibody with domain exchange and additional heavy chain C-terminal binding site or a full-length antibody with an additional heavy chain C-terminal binding site with domain exchange or a T-cell bispecific antibody. In certain embodiments, the antibody is bi-or trivalent.

One aspect of the invention is the use of the nucleic acid according to the invention to enhance the yield or the quality of multimeric polypeptides produced by recombinant protein expression systems, for example in the manufacture of antibodies, such as monoclonal antibodies.

In certain embodiments of all aspects and embodiments of the use of the nucleic acid according to the invention, the nucleic acid according to the invention is an antisense oligonucleotide.

In certain embodiments of all aspects and embodiments of the use of the nucleic acid according to the invention, the nucleic acid according to the invention is complementary to at least 10 contiguous nucleotides of the hamster XBP1 pre-mRNA transcript (SEQ ID NO 1), such as at least 10 contiguous nucleotides from nucleotides 2960-3113 of SEQ ID NO 1 or at least 10 contiguous nucleotides from nucleotides 2986-3018 of SEQ ID NO 1.

In certain embodiments of all aspects and embodiments of the use of the nucleic acid according to the invention, the nucleic acid according to the invention is complementary to at least 10 contiguous nucleotides of the human XBP1 pre-mRNA transcript (SEQ ID NO 801).

In certain embodiments of all aspects and embodiments of the use of the nucleic acid according to the invention, the nucleic acid according to the invention is complementary to a sequence selected from the group consisting of SEQ ID NO 947, SEQ ID NO 948, SEQ ID NO 949, SEQ ID NO 950, SEQ ID NO 951 and SEQ ID NO 988.

In certain embodiments of all aspects and embodiments of the use of the nucleic acid according to the invention, the nucleic acid according to the invention is selected from the group consisting of SEQ ID NO 854, SEQ ID NO 855, SEQ ID NO 856, SEQ ID NO 857, SEQ ID NO 858 and SEQ ID NO 895.

One further aspect of the invention is the use of an XBP1 variant obtained from an XBP1 mRNA wherein exon 4 is skipped and +2 out of frame event is introduced to enhance the yield or the quality of multimeric polypeptides produced by recombinant protein expression systems, for example in the manufacture of antibodies, such as monoclonal antibodies.

One further aspect of the invention is the use of an XBP1 variant comprising the sequence of SEQ ID NO: 7, SEQ ID NO: 596 or SEQ ID NO 807 to enhance the yield or the quality of multimeric polypeptides produced by recombinant protein expression systems, for example in the manufacture of antibodies, such as monoclonal antibodies.

In certain embodiments of all aspects and embodiments of the before outlined uses, the nucleic acid according to the invention is used at a final concentration of 25 UM or more.

In another aspect, the invention provides a therapeutic application for the antisense oligonucleotides, compositions, pharmaceutical compositions, proteins and/or isolated mRNAs of the invention.

In one aspect, the invention provides an antisense oligonucleotide, composition, pharmaceutical composition, protein and/or isolated mRNA of the invention for use in medicine or therapy.

In another aspect, the invention provides the use of an antisense oligonucleotide, composition, pharmaceutical composition, protein and/or isolated mRNA of the invention in the manufacture of a medicament for the treatment of proteopathological disease.

In another aspect, the invention provides a method of treating a proteopathological disease, the method comprising administering an antisense oligonucleotide, composition, pharmaceutical composition, protein and/or isolated mRNA of the invention.

Throughout the therapeutic applications of the invention, the proteopathological disease may be a TDP-43 pathology, such as motor neuron disease or frontotemporal lobar degeneration.

Figure: 4 Alignment of protein sequences of XBP1u (SEQ ID NO: 1008), XBP1s (SEQ ID NO: 1009) and the XBP1Δ4 variant (SEQ ID NO: 1010), illustrating that exon 4 removal results in the retention of the majority of the C-terminal amino acid sequence found in the IRE1 mediated splicing event (XBP1s).

Figure 1:
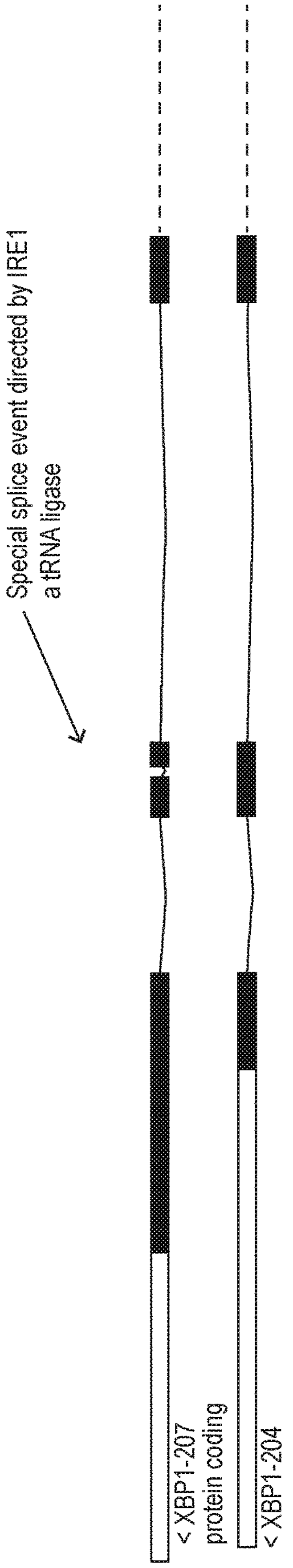
FIG. 1: Illustration of the IRE1 mediated splicing event in the human XBP1 transcript XBP1-207 (SEQ ID Nos: 1006-1007).
Figure 2:
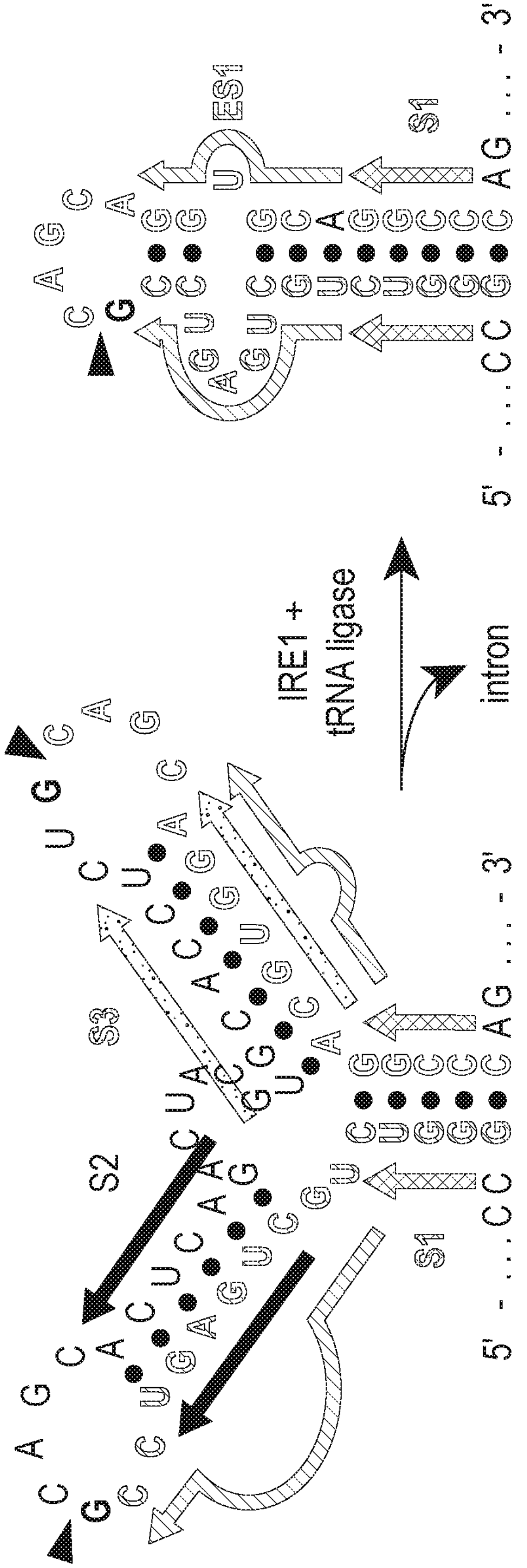
FIG. 2: Illustration of the proposed mechanism for the alternative IRE1 mediated splicing event. The left side of the figure illustrates SEQ ID NO: 134, SEQ ID NOs: 122-125, and SEQ ID NO: 241; the right side of the figure illustrates SEQ ID NOs: 134 and 241.
Figure 3:
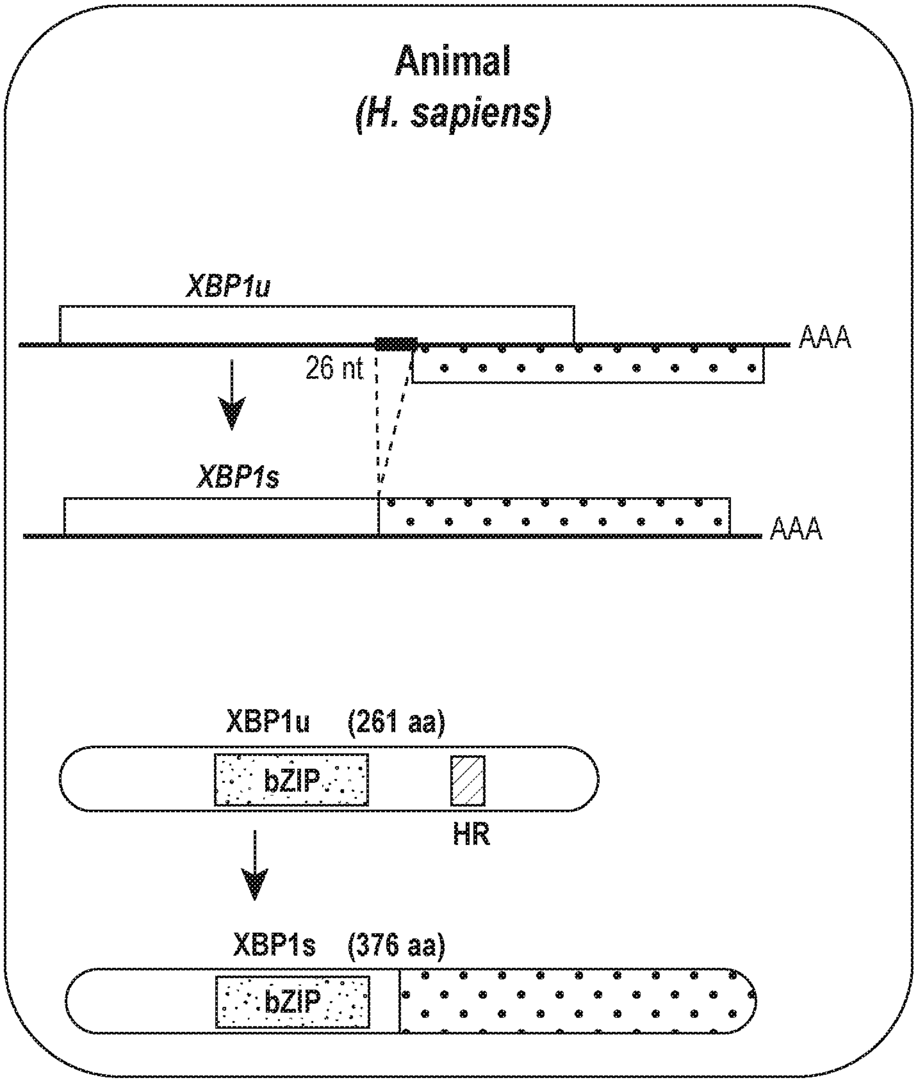
FIG. 3: Illustration of the consequence of the IRE1 mediated splicing event on XBP1 pre-mRNA, resulting in a mRNA XBP1s that encodes an extended C-terminal domain.
Figure 5:
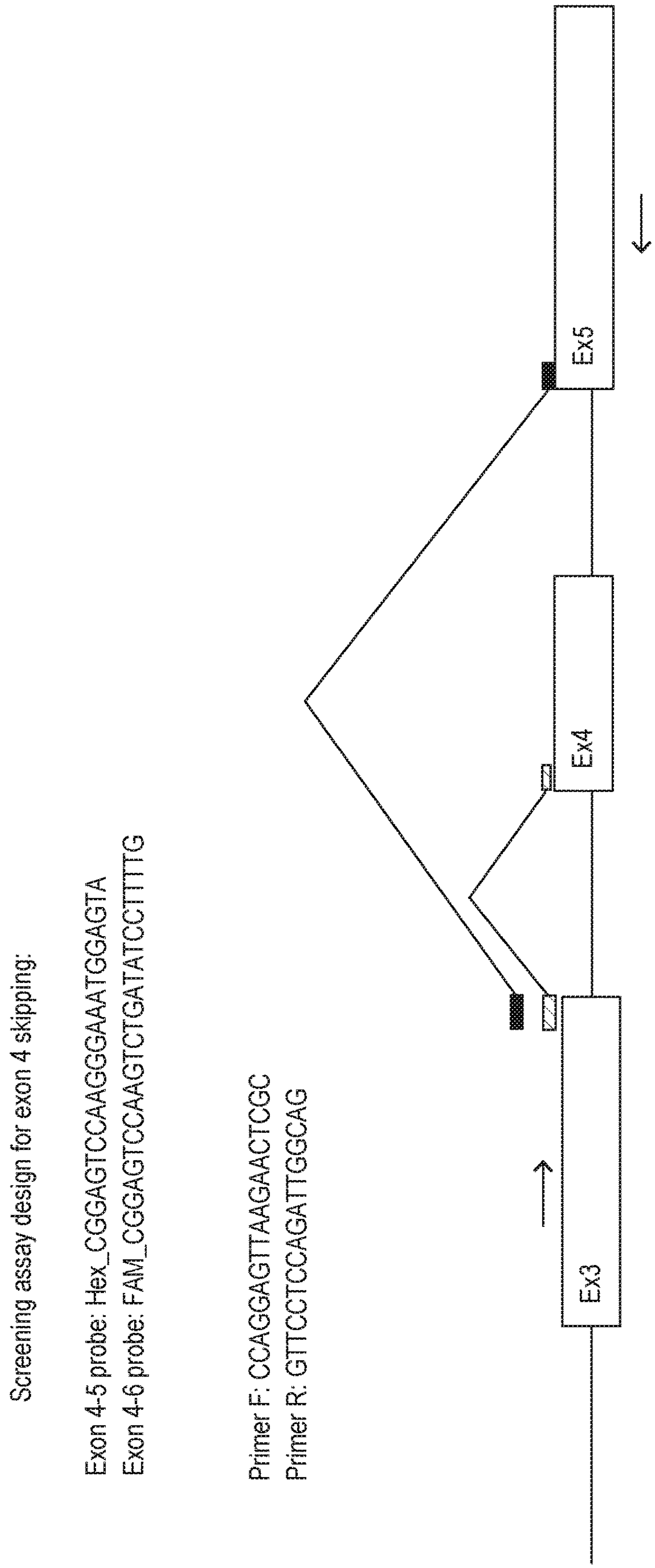

FIG. 5: Screening Assay Design for XBP1 exon 4 skipping; Exon 4-5 probe (SEQ ID NO: 1499), Exon 4-6 probe (SEQ ID NO: 1502), Primer F (SEQ ID NO: 1498), Primer R (SEQ ID NO: 1497).

Figure 6:
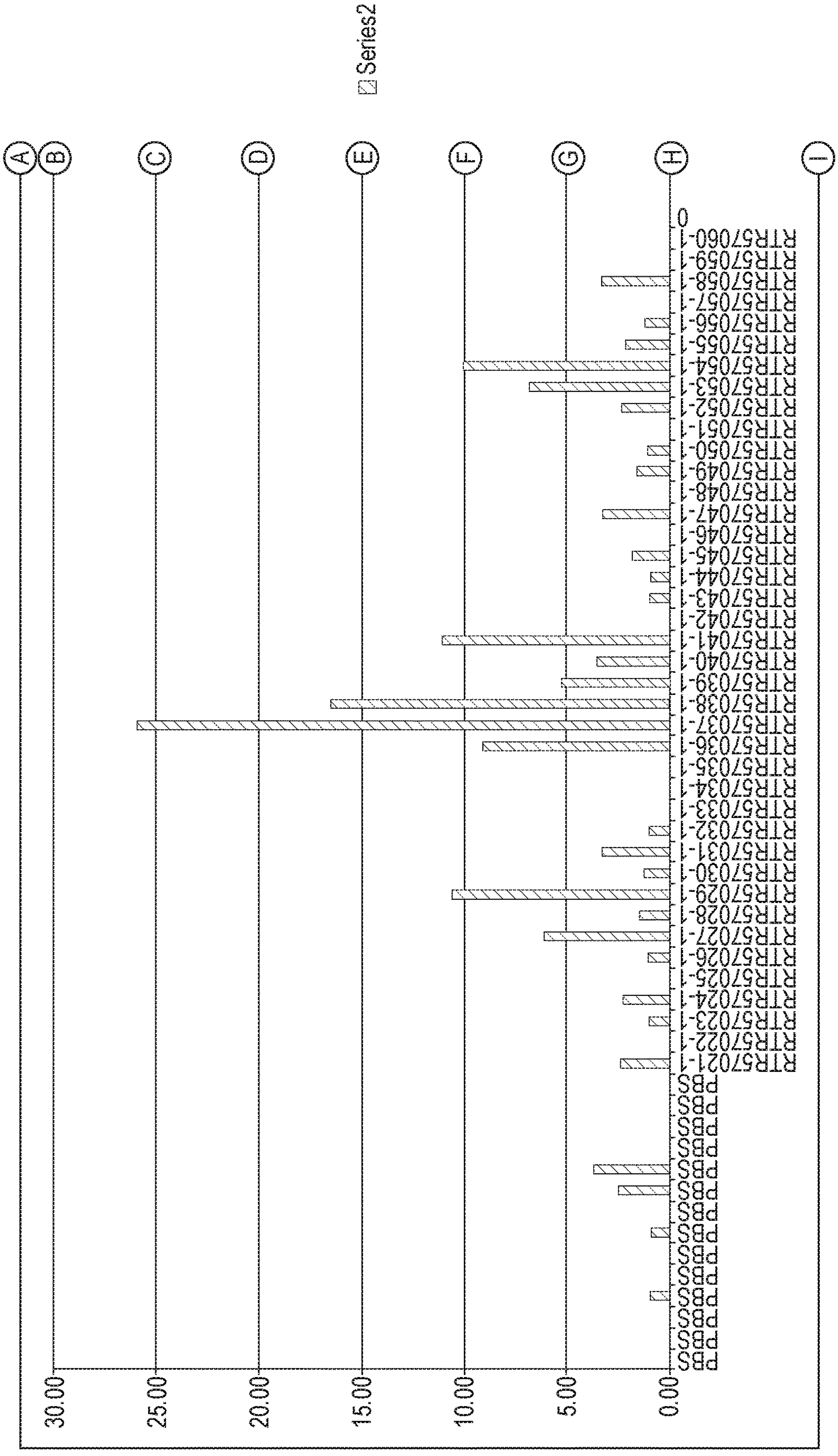
Figure 6:
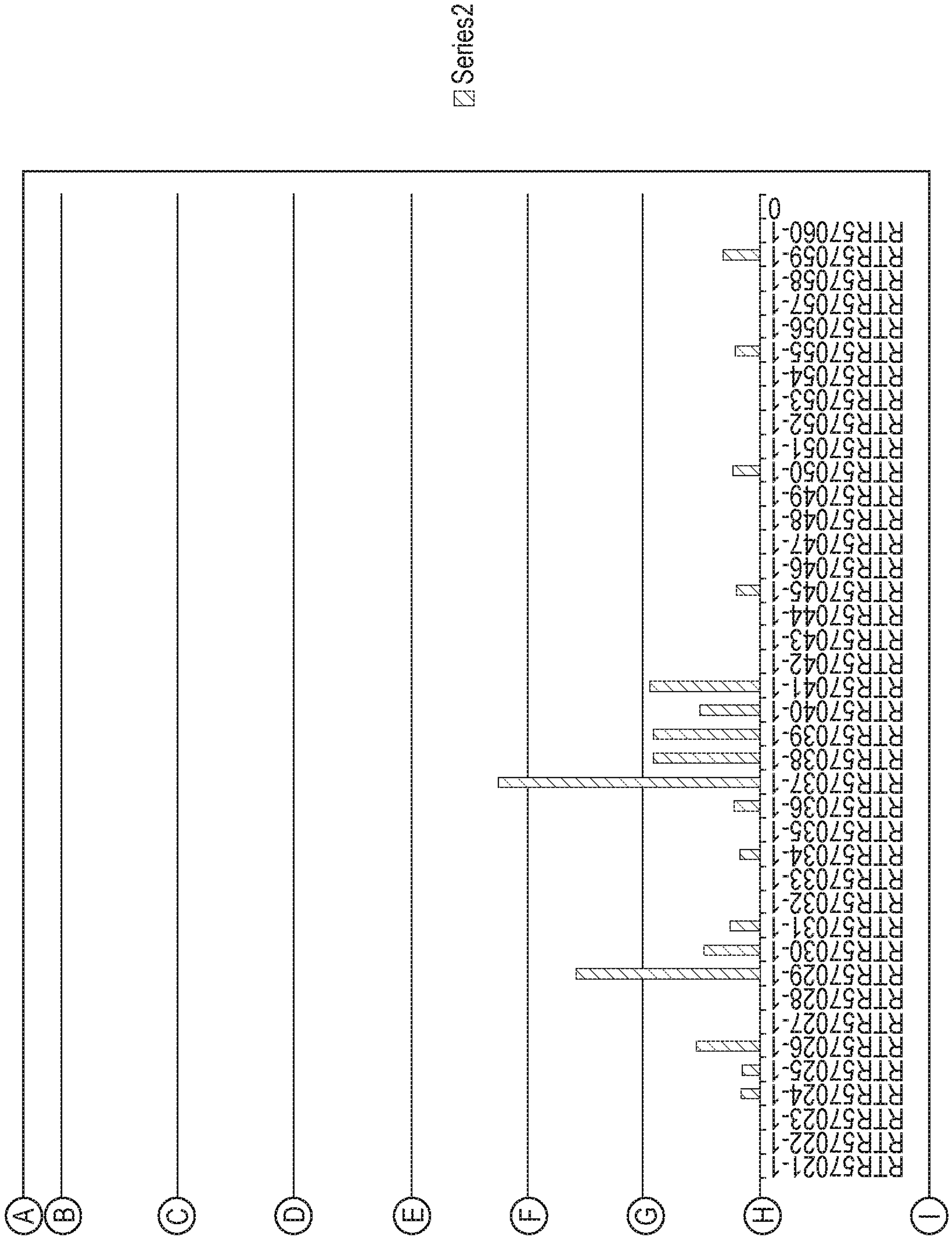

FIG. 6: Initial library screen of antisense oligonucleotides targeting nucleotides 2960-3113 of SEQ ID NO 1, identifying compounds which are effective in mediating the skipping of exon 4.

Figure 7:
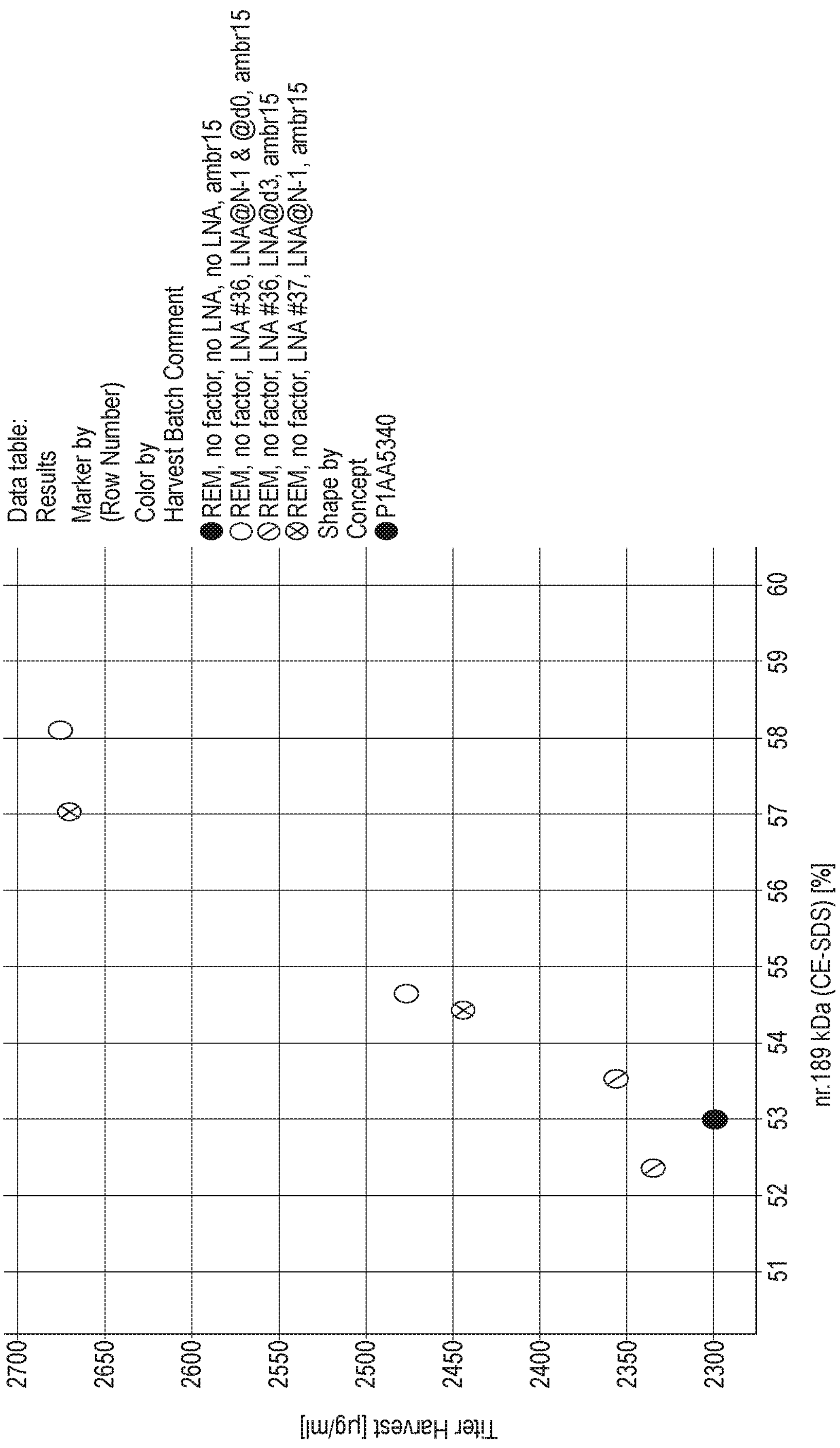

FIG. 7: Effective exon 4 splice switching compounds, e.g. SEQ ID NOs 23 and 24 increase the titre of CHO cell expressing difficult-to-express mAb.

Figure 8:
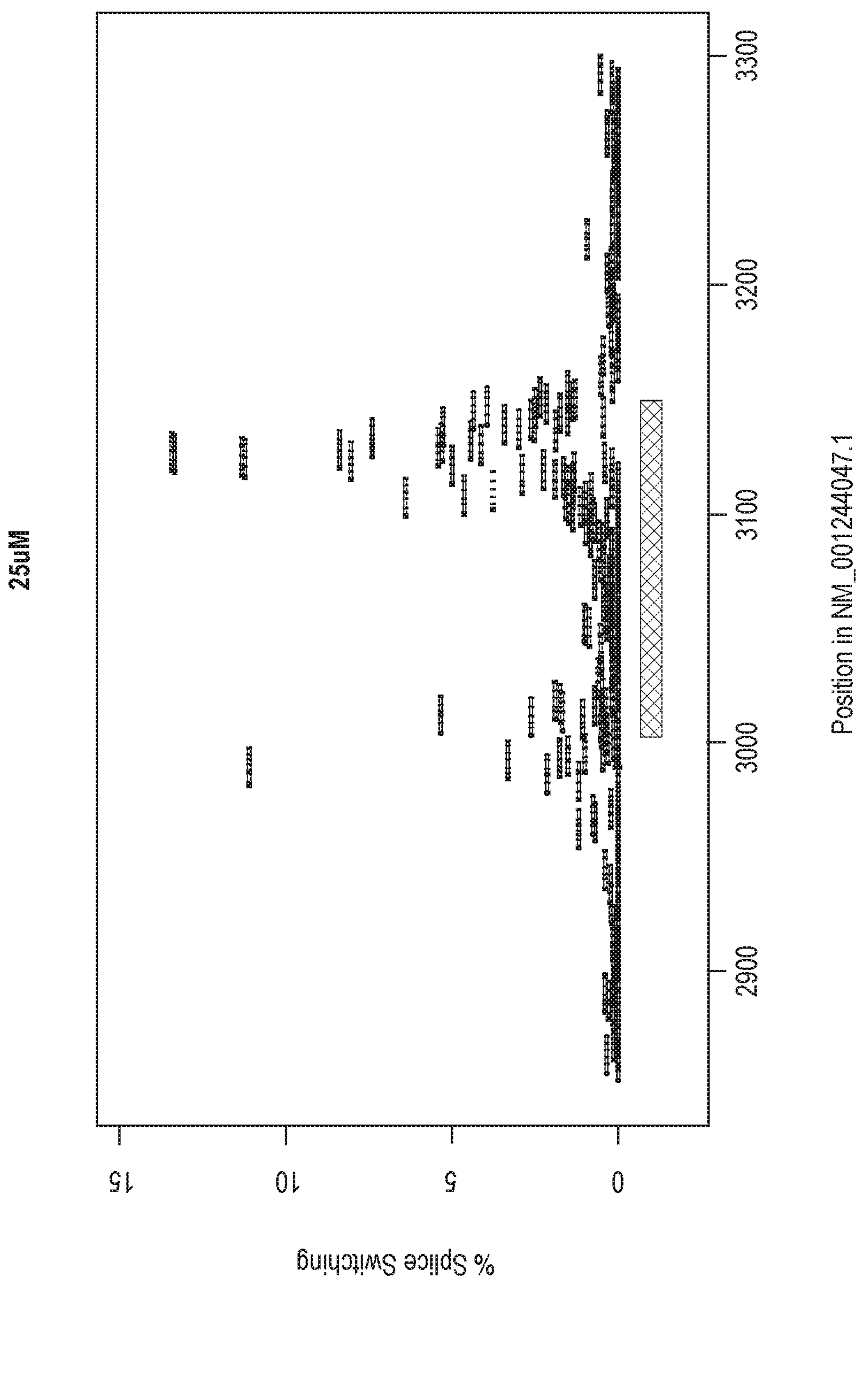

FIG. 8: Activity of oligonucleotides is shown relative to their position along exon 4 of SEQ ID 2.

FIG. 9: Alignment of XBP1s highlighting conservation in the Exon 4 sequence across key species (SEQ ID NOs 5, 594 & 805).

FIG. 10: Alignment of XBPA4 highlighting conservation in the Exon 4 sequence across key species (SEQ ID NOs 7, 596 & 807).

FIG. 11: Alignment of human XBP1s (SEQ ID NO 805) and XBPA4 (SEQ ID NO 807).

DEFINITIONS

General

Useful methods and techniques for carrying out the current invention are described in e.g. Ausubel, F. M. (ed.), Current Protocols in Molecular Biology, Volumes I to III (1997); Glover, N. D., and Hames, B. D., ed., DNA Cloning: A Practical Approach, Volumes I and II (1985), Oxford University Press; Freshney, R. I. (ed.), Animal Cell Culture-a practical approach, IRL Press Limited (1986); Watson, J. D., et al., Recombinant DNA, Second Edition, CHSL Press (1992); Winnacker, E. L., From Genes to Clones; N.Y., VCH Publishers (1987); Celis, J., ed., Cell Biology, Second Edition, Academic Press (1998); Freshney, R. I., Culture of Animal Cells: A Manual of Basic Technique, second edition, Alan R. Liss, Inc., N.Y. (1987).

The use of recombinant DNA technology enables the generation of derivatives of a nucleic acid. Such derivatives can, for example, be modified in individual or several nucleotide positions by substitution, alteration, exchange, deletion or insertion. The modification or derivatization can, for example, be carried out by means of site directed mutagenesis. Such modifications can easily be carried out by a person skilled in the art (see e.g. Sambrook, J., et al., Molecular Cloning: A laboratory manual (1999) Cold Spring Harbor Laboratory Press, New York, USA; Hames, B. D., and Higgins, S. G., Nucleic acid hybridization-a practical approach (1985) IRL Press, Oxford, England).

It must be noted that as used herein and in the appended claims, the singular forms "a", "an", and "the" include plural reference unless the context clearly dictates otherwise. Thus, for example, reference to "a cell" includes a plurality of such cells and equivalents thereof known to those skilled in the art, and so forth. As well, the terms "a" (or "an"), "one or more" and "at least one" can be used interchangeably herein. It is also to be noted that the terms "comprising", "including", and "having" can be used interchangeably.

The term "about" denotes a range of +/−20% of the thereafter following numerical value. In one embodiment, the term about denotes a range of +/−10% of the thereafter following numerical value. In one embodiment the term "about" denotes a range of +/−5% of the thereafter following numerical value.

The term "comprising" also encompasses the term "consisting of".

Compound

Herein, in the context of compounds of the present invention the term "compound" means any molecule capable of modulating the expression or activity of XBP1, particularly any molecule capable of modulating the splicing of the XBP1 pre-mRNA to increase the level of expression of XBP1 an XBP1 splice variant, such as an mRNA which lacks XBP1 exon 4. Particular compounds of the invention are nucleic acid molecules, such as antisense oligonucleotides, and conjugates comprising such a nucleic acid molecule.

Recombinant Mammalian Cell

The term "recombinant mammalian cell" as used herein denotes a mammalian cell comprising an exogenous nucleotide sequence capable of expressing a polypeptide. Such a polypeptide can be a polypeptide endogenous or heterologous (exogeneous) to said mammalian cell. Such recombinant mammalian cells are cells into which one or more exogenous nucleic acid(s) have been introduced, including the progeny of such cells. Thus, the term "a mammalian cell comprising a nucleic acid encoding a heterologous polypeptide" denotes cells comprising an exogenous nucleotide sequence integrated in the genome of the mammalian cell and capable of expressing the heterologous polypeptide. In one embodiment the mammalian cell comprising an exogenous nucleotide sequence is a cell comprising an exogenous nucleotide sequence integrated at a single site within a locus of the genome of the host cell, wherein the exogenous nucleotide sequence comprises a first and a second recombination recognition sequence flanking at least one first selection marker, and a third recombination recognition sequence located between the first and the second recombination recognition sequence, and all the recombination recognition sequences are different.

Such "recombinant mammalian cells" can be used for the production of said homologous or heterologous polypeptide of interest at any scale.

Transformed Cells

A mammalian cell comprising an exogenous nucleotide sequence is a "transformed cell". This term includes the primary transformed cell as well as progeny derived therefrom without regard to the number of passages. Progeny may, e.g., not be completely identical in nucleic acid content to a parent cell, but may contain mutations. Mutant progeny that has the same function or biological activity as screened or selected for in the originally transformed cell are encompassed.

Isolated

An "isolated" composition is one that has been separated from a component of its natural environment. In some embodiments, a composition is purified to greater than 95% or 99% purity as determined by, for example, electrophoretic (e.g., SDS-PAGE, isoelectric focusing (IEF), capillary electrophoresis, CE-SDS) or chromatographic (e.g., size exclusion chromatography or ion exchange or reverse phase HPLC) methods. For a review of methods for assessment of e.g. antibody purity, see, e.g., Flatman, S. et al., J. Chrom. B 848 (2007) 79-87.

An "isolated" nucleic acid refers to a nucleic acid molecule that has been separated from a component of its natural environment. An isolated nucleic acid includes a nucleic acid molecule contained in cells that ordinarily contain the nucleic acid molecule, but wherein the nucleic acid molecule is present extrachromosomally or at a chromosomal location that is different from its natural chromosomal location.

An "isolated" polypeptide or antibody refers to a polypeptide molecule or antibody molecule that has been separated from a component of its natural environment.

Integration Site

The term "integration site" denotes a nucleic acid sequence within a cell's genome into which an exogenous nucleotide sequence is inserted. In certain embodiments, an integration site is between two adjacent nucleotides in the cell's genome. In certain embodiments, an integration site includes a stretch of nucleotide sequences. In certain embodiments, the integration site is located within a specific locus of the genome of a mammalian cell. In certain embodiments, the integration site is within an endogenous gene of a mammalian cell.

The terms "vector" or "plasmid", which can be used interchangeably, as used herein, refer to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors".

Selection Marker

As used herein, the term "selection marker" denotes a gene that allows cells carrying the gene to be specifically selected for or against, in the presence of a corresponding selection agent. For example, but not by way of limitation, a selection marker can allow the host cell transformed with the selection marker gene to be positively selected for in the presence of the respective selection agent (selective cultivation conditions); a non-transformed host cell would not be capable of growing or surviving under the selective cultivation conditions. Selection markers can be positive, negative or bi-functional. Positive selection markers can allow selection for cells carrying the marker, whereas negative selection markers can allow cells carrying the marker to be selectively eliminated. A selection marker can confer resistance to a drug or compensate for a metabolic or catabolic defect in the host cell. In prokaryotic cells, amongst others, genes conferring resistance against ampicillin, tetracycline, kanamycin or chloramphenicol can be used. Resistance genes useful as selection markers in eukaryotic cells include, but are not limited to, genes for aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid. Further marker genes are described in WO 92/08796 and WO 94/28143.

Beyond facilitating a selection in the presence of a corresponding selection agent, a selection marker can alternatively be a molecule normally not present in the cell, e.g., green fluorescent protein (GFP), enhanced GFP (eGFP), synthetic GFP, yellow fluorescent protein (YFP), enhanced YFP (eYFP), cyan fluorescent protein (CFP), mPlum, mCherry, tdTomato, mStrawberry, J-red, DsRed-monomer, mOrange, mKO, mCitrine, Venus, YPet, Emerald, CyPet, mCFPm, Cerulean, and T-Sapphire. Cells expressing such a molecule can be distinguished from cells not harbouring this gene, e.g., by the detection or absence, respectively, of the fluorescence emitted by the encoded polypeptide.

Operably Linked

As used herein, the term "operably linked" refers to a juxtaposition of two or more components, wherein the components are in a relationship permitting them to function in their intended manner. For example, a promoter and/or an enhancer is operably linked to a coding sequence if the promoter and/or enhancer acts to modulate the transcription of the coding sequence. In certain embodiments, DNA sequences that are "operably linked" are contiguous and adjacent on a single chromosome. In certain embodiments, e.g., when it is necessary to join two protein encoding regions, such as a secretory leader and a polypeptide, the sequences are contiguous, adjacent, and in the same reading frame. In certain embodiments, an operably linked promoter is located upstream of the coding sequence and can be adjacent to.it. In certain embodiments, e.g., with respect to enhancer sequences modulating the expression of a coding sequence, the two components can be operably linked although not adjacent. An enhancer is operably linked to a coding sequence if the enhancer increases transcription of the coding sequence. Operably linked enhancers can be located upstream, within, or downstream of coding sequences and can be located at a considerable distance from the promoter of the coding sequence. Operable linkage can be accomplished by recombinant methods known in the art, e.g., using PCR methodology and/or by ligation at convenient restriction sites. If convenient restriction sites do not exist, then synthetic oligonucleotide adaptors or linkers can be used in accord with conventional practice. An internal ribosomal entry site (IRES) is operably linked to an open reading frame (ORF) if it allows initiation of translation of the ORF at an internal location in a 5'-end-independent manner.

Exogenous

As used herein, the term "exogenous" indicates that a nucleotide sequence does not originate from a specific cell and is introduced into said cell by DNA delivery methods, e.g., by transfection, electroporation, or transformation methods. Thus, an exogenous nucleotide sequence is an artificial sequence wherein the artificiality can originate, e.g., from the combination of subsequences of different origin (e.g. a combination of a recombinase recognition sequence with an SV40 promoter and a coding sequence of green fluorescent protein is an artificial nucleic acid) or from the deletion of parts of a sequence (e.g. a sequence coding only the extracellular domain of a membrane-bound receptor or a cDNA) or the mutation of nucleobases. The term "endogenous" refers to a nucleotide sequence originating from a cell. An "exogenous" nucleotide sequence can partly have an "endogenous" counterpart that is identical in base compositions, but where the "exogenous" sequence is introduced into the cell, e.g., via recombinant DNA technology.

Heterologous

As used herein, the term "heterologous" indicates that a polypeptide does not originate from a specific cell and the respective encoding nucleic acid has been introduced into said cell by DNA delivery methods, e.g., by transfection, electroporation, or transformation methods. Thus, a heterologous polypeptide is a polypeptide that is artificial to the cell expressing it, whereby this is independent of whether the polypeptide is a naturally occurring polypeptide originating from a different cell/organism or is a man-made polypeptide.

Oligonucleotide

The term "oligonucleotide" as used herein is defined as it is generally understood by the skilled person, as a molecule comprising two or more covalently linked nucleosides. Such covalently bound nucleosides can also be referred to as nucleic acid molecules or oligomers. Oligonucleotides are commonly made in the laboratory by solid-phase chemical synthesis followed by purification and isolation. When referring to a sequence of the oligonucleotide, reference is made to the sequence or order of nucleobase moieties, or modifications thereof, of the covalently linked nucleotides or nucleosides. In some embodiments, the oligonucleotides of the invention are man-made, and are chemically synthesized, and are typically purified or isolated. The oligonucleotides of the invention can comprise one or more modified nucleosides, also referred to as nucleoside analogues, such as 2' sugar modified nucleosides. The oligonucleotides of the invention can comprise one or more modified internucleoside linkages, such as one or more phosphorothioate internucleoside linkages.

Antisense Oligonucleotide

The term "antisense oligonucleotide" or "ASO," as used herein, is defined as an oligonucleotide capable of modulating expression of a target gene by hybridizing to a target nucleic acid, in particular to a contiguous sequence on a target nucleic acid. Antisense oligonucleotides are not essentially double stranded and are therefore not siRNAs or shRNAs. In some embodiments, the antisense oligonucleotides of the present invention can be single stranded. It is understood that single stranded oligonucleotides of the present invention can form hairpins or intermolecular duplex structures (duplex between two molecules of the same oligonucleotide), as long as the degree of intra or inter self-complementarity is less than approximately 50% across the full length of the oligonucleotide. In some embodiments, the single stranded antisense oligonucleotides of the invention do not contain RNA nucleosides. As described elsewhere in the present disclosure, in some embodiments, antisense oligonucleotides of the disclosure comprise one or more modified nucleosides or nucleotides, such as 2' sugar modified nucleosides. In certain embodiments, the non-modified nucleosides of an antisense oligonucleotide disclosed herein are DNA nucleosides.

In certain contexts, the antisense oligonucleotides of the invention may be referred to as oligonucleotides.

Contiguous Nucleotide Sequence

The term "contiguous nucleotide sequence" refers to the region of an antisense oligonucleotide which is complementary to the target nucleic acid. The term is used interchangeably herein with the term "contiguous nucleobase sequence" and the term oligonucleotide "sequence motif." As used herein, the term "sequence motif" represents the sequence of nucleobases, independent of the nucleoside sugar chemistry and/or design. In some embodiments, the nucleobases A, T, C and G can be modified, for example, capital C can be 5-methyl cytosine beta-D-oxy LNA nucleoside, and in RNA sequences, T can be U. In some embodiments, all the nucleosides of an antisense oligonucleotide constitute the contiguous nucleotide sequence. The contiguous nucleotide sequence is the sequence of nucleotides in the antisense oligonucleotide which is complementary to, and in some instances fully complementary to, the target nucleic acid or target sequence.

As described herein, in some embodiments, an antisense oligonucleotide comprises the contiguous nucleotide sequence, and can optionally comprise further nucleotide(s), for example a nucleotide linker region which can be used to attach a functional group (e.g. a conjugate group) to the contiguous nucleotide sequence. In some embodiments, the nucleotide linker region can be complementary to the target nucleic acid. In some embodiments, the nucleotide linker region is not complementary to the target nucleic acid. It is understood that the contiguous nucleotide sequence of an antisense oligonucleotide cannot be longer than the antisense oligonucleotide as such, and that the antisense oligonucleotide cannot be shorter than the contiguous nucleotide sequence.

Nucleic Acids

The term "nucleic acids" or "nucleotides" is intended to encompass plural nucleic acids. In some embodiments, the term "nucleic acids" or "nucleotides" refers to a target sequence, e.g., pre-mRNAs, mRNAs, or DNAs in vivo or in vitro.

When the term refers to the nucleic acids or nucleotides in a target sequence, the nucleic acids or nucleotides can be naturally occurring sequences within a cell. In some embodiments, "nucleic acids" or "nucleotides" refer to a sequence in the antisense oligonucleotide of the invention. When the term refers to a sequence in the antisense oligonucleotide, the nucleic acids or nucleotides are not naturally occurring, i.e., chemically synthesized, enzymatically produced, recombinantly produced, or any combination thereof. In some embodiments, the nucleic acids or nucleotides in the antisense oligonucleotide are produced synthetically or recombinantly, but are not a naturally occurring sequence or a fragment thereof. In some embodiments, the nucleic acids or nucleotides in the antisense oligonucleotide are not naturally occurring because they contain at least one nucleotide analog that is not naturally occurring in nature.

The term "nucleic acid" or "nucleotide" refers to a single nucleic acid segment, e.g., a DNA, an RNA, or an analog thereof, in isolated form or present in a polynucleotide. "Nucleic acid" or "nucleotide" includes naturally occurring nucleic acids or non-naturally occurring nucleic acids. In some embodiments, the terms "nucleotide", "unit" and "monomer" are used interchangeably. It will be recognized that when referring to a sequence of nucleotides or monomers, what is referred to is the sequence of bases, such as A, T, G, Cor U, and analogs thereof.

When the term refers to the nucleic acid or nucleic acids encoding a polypeptide or protein, the nucleic acids or nucleotides can be naturally occurring sequences within a cell or an artificial sequence. In some embodiments, the nucleic acid(s) are produced synthetically or recombinantly.

Nucleotide

The term "nucleotide," as used herein, refers to a glycoside comprising a sugar moiety, a base moiety and a covalently linked group (linkage group), such as a phosphate or phosphorothioate internucleotide linkage group, and covers both naturally occurring nucleotides, such as DNA or RNA, and non-naturally occurring nucleotides comprising modified sugar and/or base moieties, which are also referred to as "nucleotide analogs" herein. Herein, a single nucleotide (unit) can also be referred to as a monomer or nucleic acid unit. In certain embodiments, the term "nucleotide analogs" refers to nucleotides having modified sugar moieties. Non-limiting examples of the nucleotides having modified sugar moieties (e.g., LNA) are disclosed elsewhere herein. In some embodiments, the term "nucleotide analogs" refers to nucleotides having modified nucleobase moieties. The nucleotides having modified nucleobase moieties include, but are not limited to, 5-methyl-cytosine, isocytosine, 5-thiozolo-cytosine, 5-propynyl-cytosine, pseudoisocytosine, 5-bromouracil, 5-propynyl-uracil, thiazolo-uracil, 2-thio-uracil, 2-thiothymine, 6-aminopurine, 2-aminopurine, inosine, diaminopurine, 2,6-diaminopurine, and 2-chloro-6-aminopurine. As one of ordinary skill in the art would recognize, the 5' terminal nucleotide of an oligonucleotide (e.g., an antisense oligonucleotide disclosed herein) does not comprise a 5' internucleotide linkage group, although it can comprise a 5' terminal group.

Nucleoside

The term "nucleoside," as used herein, is used to refer to a glycoside comprising a sugar moiety and a base moiety, and can therefore be used when referring to the nucleotide units, which are covalently linked by the internucleotide linkages between the nucleotides of the antisense oligonucleotide. In the field of biotechnology, the term "nucleotide" is often used to refer to a nucleic acid monomer or unit. In the context of an antisense oligonucleotide, the term "nucleotide" can refer to the base alone, i.e., a nucleobase sequence comprising cytosine (DNA and RNA), guanine (DNA and RNA), adenine (DNA and RNA), thymine (DNA) and uracil (RNA), in which the presence of the sugar backbone and internucleotide linkages are implicit. Likewise, particularly in the case of oligonucleotides where one or more of the internucleotide linkage groups are modified, the term "nucleotide" can refer to a "nucleoside." For example, the term "nucleotide" can be used, even when specifying the presence or nature of the linkages between the nucleosides.

Nucleotide Length

The term "nucleotide length" or the "length" of an antisense oligonucleotide, or contiguous nucleotide sequence thereof, as used herein means the total number of the nucleotides (monomers) in a given sequence. Nucleotides and nucleosides are the building blocks of oligonucleotides and polynucleotides, and for the purposes of the present disclosure include both naturally occurring and non-naturally occurring nucleotides and nucleosides (nucleo (s/t) ide analogs). In nature, nucleotides, such as DNA and RNA nucleotides comprise a ribose sugar moiety, a nucleobase moiety and one or more phosphate groups (which is absent in nucleosides). Nucleosides and nucleotides can also interchangeably be referred to as "units" or "monomers".

Modified Nucleoside

The term "modified nucleoside" or "nucleoside modification", or "nucleoside analog" as used herein, refers to nucleosides modified as compared to the equivalent DNA or RNA nucleoside by the introduction of one or more modifications of the sugar moiety or the (nucleo) base moiety. In some embodiments, one or more of the modified nucleosides of the antisense oligonucleotide of the invention comprise a modified sugar moiety. The term modified nucleoside can also be used herein interchangeably with the term "nucleoside analogue," modified "units," or modified "monomers." Nucleosides with an unmodified DNA or RNA sugar moiety are termed DNA or RNA nucleosides herein. In some embodiments, nucleosides with modifications in the base region of the DNA or RNA nucleoside are still termed DNA or RNA if they allow Watson Crick base pairing. Non-limiting examples of modified nucleosides which can be used in the antisense oligonucleotides of the invention include LNA, 2'-O-MOE and morpholino nucleoside analogues. Examples of other modified nucleosides are provided elsewhere in the present disclosure.

High Affinity Modified Nucleoside

A "high affinity modified nucleoside," as used herein, is a modified nucleotide which, when incorporated into the oligonucleotide, enhances the affinity of the oligonucleotide for its complementary target, for example, as measured by the melting temperature (Tm). A high affinity modified nucleoside of the present disclosure can result in an increase in melting temperature between +0.5 to +12° C., in some instances between +1.5 to +10° C. and in others between +3 to +8° C. per modified nucleoside. Numerous high affinity modified nucleosides are known in the art and include, for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3 (2), 203-213).

Modified Internucleoside Linkage

The term "modified internucleoside linkage" is defined as generally understood by the skilled person as linkages other than phosphodiester (PO) linkages that covalently couple two nucleosides together. In some embodiments, the oligonucleotides of the invention can therefore comprise one or more modified internucleoside linkages, such as one or more phosphorothioate internucleoside linkage.

In some embodiments, at least about 50% of the internucleoside linkages of the antisense oligonucleotide (e.g., disclosed herein), or contiguous nucleotide sequence thereof, are phosphorothioate, such as at least about 60%, at least about 70%, at least about 75%, at least about 80%, at least about 90% or more of the internucleoside linkages of the antisense oligonucleotide, or contiguous nucleotide sequence thereof, are phosphorothioate. In some embodiments, all of the internucleoside linkages of the antisense oligonucleotide, or contiguous nucleotide sequence thereof, are phosphorothioate.

In some embodiments, all the internucleoside linkages of the contiguous nucleotide sequence of the oligonucleotide are phosphorothioate, or all the internucleoside linkages of the antisense oligonucleotide are phosphorothioate linkages.

Nucleobase

The term "nucleobase" includes the purine (e.g. adenine and guanine) and pyrimidine (e.g. uracil, thymine and cytosine) moiety present in nucleosides and nucleotides which form hydrogen bonds in nucleic acid hybridization. In the context of the present invention, the term nucleobase also encompasses modified nucleobases which can differ from naturally occurring nucleobases, but which are functional during nucleic acid hybridization. In this context, "nucleobase" refers to both naturally occurring nucleobases such as adenine, guanine, cytosine, thymidine, uracil, xanthine and hypoxanthine, as well as non-naturally occurring variants. Such variants are, for example, described in Hirao et al (2012) Accounts of Chemical Research vol 45 page 2055 and Bergstrom (2009) Current Protocols in Nucleic Acid Chemistry Suppl. 37 1.4.1.

In some embodiments the nucleobase moiety is modified by changing the purine or pyrimidine into a modified purine or pyrimidine, such as substituted purine or substituted pyrimidine, such as a nucleobase selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties can be indicated by the letter code for each corresponding nucleobase, e.g. A, T, G, C or U, wherein each letter can optionally include modified nucleobases of equivalent function. For example, in certain embodiments, the nucleobase moieties of the antisense oligonucleotides disclosed herein are selected from A, T, G, C, and 5-methyl cytosine. Optionally, for LNA gapmers, 5-methyl cytosine LNA nucleosides can be used.

Modified Oligonucleotide

The term "modified oligonucleotide," as used herein, describes an oligonucleotide (e.g., an antisense oligonucleotide) comprising one or more modified nucleosides (e.g., sugar modified nucleosides) and/or modified internucleoside linkages. The term "chimeric oligonucleotide" is a term that has been used in the literature to describe oligonucleotides comprising modified nucleosides (e.g., sugar modified nucleosides) and DNA nucleosides. In some embodiments, the ASO of the disclosure is a chimeric oligonucleotide.

Alkyl

As used herein, the term "alkyl", alone or in combination, signifies a straight-chain or branched-chain alkyl group with 1 to 8 carbon atoms (C1-8), particularly a straight or branched-chain alkyl group with 1 to 6 carbon atoms (C1-6) and more particularly a straight or branched-chain alkyl group with 1 to 4 carbon atoms (C1-4). Examples of straight-chain and branched-chain C1-C8alkyl groups are methyl, ethyl, propyl, isopropyl, butyl, isobutyl, tert-butyl, the isomeric pentyls, the isomeric hexyls, the isomeric heptyls and the isomeric octyls, particularly methyl, ethyl, propyl, butyl and pentyl. Particular examples of alkyl are methyl. Further examples of alkyl are mono, di or trifluoro methyl, ethyl or propyl, such as cyclopropyl (cPr), or mono, di or tri fluoro cyclopropyl.

Alkoxy

The term "alkoxy", alone or in combination, signifies a group of the formula alkyl-O- in which the term "alkyl" has the previously given significance, such as methoxy, ethoxy, n-propoxy, isopropoxy, n-butoxy, isobutoxy, sec.butoxy and tert.butoxy. Particular "alkoxy" are methoxy.

Bicyclic Sugar

As used herein, the term "bicyclic sugar" refers to a modified sugar moiety comprising a 4 to 7 membered ring comprising a bridge connecting two atoms of the 4 to 7 membered ring to form a second ring, resulting in a bicyclic structure. In some embodiments, the bridge connects the C2' and C4' of the ribose sugar ring of a nucleoside (i.e., 2'-4' bridge), as observed in LNA nucleosides.

Exons

As used herein, the term "exons" or "exonic regions" or "exonic sequences", which can be used interchangeably herein, refer to nucleic acid molecules containing a sequence of nucleotides that is transcribed into RNA and is represented in a mature form of RNA, such as mRNA (messenger RNA), after splicing and other RNA processing. An mRNA contains one or more exons operatively linked. In some embodiments, exons can encode polypeptides or a portion of a polypeptide. In some embodiments, exons can contain non-translated sequences, for example, translational regulatory sequences.

Introns

The term "introns" or "intronic regions" or "intronic sequences", which can be used interchangeably, refer to nucleic acid molecules containing a sequence of nucleotides that is transcribed into RNA and is then typically removed from the RNA by splicing to create a mature form of an RNA, for example, an mRNA. In some embodiments, nucleotide sequences of introns are not incorporated into mature RNAs, nor are intron sequences or portions thereof translated and incorporated into a polypeptide. Splice signal sequences, such as splice donors and acceptors, are used by the splicing machinery of a cell to remove introns from RNA. In some embodiments, an intron in one splice variant can be an exon (i.e., present in the spliced transcript) in another variant. Hence, spliced mRNA encoding an intron fusion protein can include an exon(s) and introns.

Splicing

As used herein, the term "splicing" refers to a process of RNA maturation in which introns in the pre-mRNA are removed and exons are operatively linked to create a messenger RNA (mRNA).

Alternative Splicing

As used herein, the term "alternative splicing" refers to the process of producing multiple mRNAs from a gene. In some embodiments, alternate splicing can include operatively linking less than all the exons of a gene, and/or operatively linking one or more alternate exons that are not present in all transcripts derived from a gene.

Splice Modulation

The term "splice modulation," as used herein, refers to a process that can be used to correct cryptic splicing, modulate alternative splicing, restore the open reading frame, and induce protein knockdown. In the context of the present invention, a splice modulation can be used to modulate alternative splicing of XBP1 pre-mRNA to generate a splice variant. For example, a splice modulation can be used to modulate alternative splicing of XBP1 pre-mRNA to generate XBP1Δ4 mRNA and thereby enhance expression of XBP1Δ4 protein. Splice modulation can be assayed by RNA sequencing (RNA-Seq), which allows for a quantitative assessment of the different splice products of a pre-mRNA. In some embodiments of the invention, the antisense oligonucleotides modulate the splicing of the XBP1 pre-mRNA so as to reduce the level of mature XBP1 mRNA which comprises an exon 4 (mRNA), and to increase the expression of the level of mature XBP1 mRNA which lacks exon 4 (XBP1Δ4 mRNA).

Coding Region

As used herein, a "coding region" or "coding sequence", which can be used interchangeably, is a portion of polynucleotide which consists of codons translatable into amino acids. Although a "stop codon" (TAG, TGA, or TAA) is typically not translated into an amino acid, it can be considered to be part of a coding region, but any flanking sequences, for example promoters, ribosome binding sites, transcriptional terminators, introns, untranslated regions ("UTRs"), and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide.

Non-Coding Region

The term "non-coding region" as used herein means a nucleotide sequence that is not a coding region. Examples of non-coding regions include, but are not limited to, promoters, ribosome binding sites, transcriptional terminators, introns, untranslated regions ("UTRs"), non-coding exons and the like. Some of the exons can be wholly or part of the 5' untranslated region (5' UTR) or the 3' untranslated region (3' UTR) of each transcript. The untranslated regions are important for efficient translation of the transcript and for controlling the rate of translation and half-life of the transcript.

Region

The term "region" when used in the context of a nucleotide sequence refers to a section of that sequence. For example, the phrase "region within a nucleotide sequence" or "region within the complement of a nucleotide sequence" refers to a sequence shorter than the nucleotide sequence, but longer than at least 10 nucleotides located within the particular nucleotide sequence or the complement of the nucleotides sequence, respectively. The term “sub-sequence” or “subsequence” can also refer to a region of a nucleotide sequence.

Downstream and Upstream

The term “downstream,” when referring to a nucleotide sequence, means that a nucleic acid or a nucleotide sequence is located 3' to a reference nucleotide sequence. In certain embodiments, downstream nucleotide sequences relate to sequences that follow the starting point of transcription. For example, the translation initiation codon of a gene is located downstream of the start site of transcription.

The term “upstream” refers to a nucleotide sequence that is located 5' to a reference nucleotide sequence. In certain embodiments, upstream nucleotide sequences relate to sequences that precede the starting point of transcription. For example, the promoter sequence of a gene is located upstream of the start site of transcription.

Regulatory Region

As used herein, the term “regulatory region” refers to nucleotide sequences located upstream (5' non-coding sequences), within, or downstream (3' non-coding sequences) of a coding region, and which influence the transcription, RNA processing, stability, or translation of the associated coding region. Regulatory regions can include promoters, translation leader sequences, introns, polyadenylation recognition sequences, RNA processing sites, effector binding sites, UTRs, and stem-loop structures. If a coding region is intended for expression in a eukaryotic cell, a polyadenylation signal and transcription termination sequence will usually be located 3' to the coding sequence.

Target Sequence

The term “target sequence,” as used herein, refers to a sequence of nucleotides present in the target nucleic acid which comprises the nucleobase sequence which is complementary to the antisense oligonucleotides of the invention, i.e. in the context of the present invention, a mammalian XBP1 pre-mRNA sequence is a target nucleic acid, and the target sequence is a region of the target nucleic acid which can be effectively targeted to modulate the splicing of exon 4, and includes, for example XBP1 exon 4, and the regions adjacent 5' and/or 3' to exon 4, of a XBP1 pre-mRNA transcript, For example, for the present invention the target nucleic acid may be the hamster XBP1 pre-mRNA (SEQ ID NO 1, and particularly nucleotides 2960-3113 of SEQ ID NO 1), the mouse XBP1 pre-mRNA (SEQ ID NO 590) or the human XBP1 pre-mRNA (SEQ ID NO 801).

In some embodiments, the target sequence consists of a region on the target nucleic acid with a nucleobase sequence that is complementary to the contiguous nucleotide sequence of the antisense oligonucleotide of the invention. This region of the target nucleic acid can interchangeably be referred to as the target nucleotide sequence, target sequence, or target region. In some embodiments, the target sequence is longer than the complementary sequence of a single antisense oligonucleotide, and can, for example, represent a preferred region of the target nucleic acid, which can be targeted by several oligonucleotides of the invention.

The Cell or Target Cell

As used herein, the term “target cell” refers to a cell which expresses the target nucleic acid. In some embodiments, the target cell comprises a mammalian cell, such as a rodent cell, such as a mouse cell or a rat cell, or a hamster cell, such as a CHO cell, or a primate cell such as a monkey cell or a human cell. In some embodiments, the target cell is a transgenic mammalian cell which is expressing a XBP1 target nucleic acid. In some embodiments, the cell is a transgenic animal cell which is expressing a XBP1Δ4 mRNA, for example via heterologous expression.

Due to its general use in heterologous protein expression a preferred cell for use in protein expression methods is a hamster cell, such as a Chinese hamster ovary cell (CHO cell), especially preferred is a CHO-K1 cell growing in suspension.

Due to the therapeutic applications of the antisense oligonucleotides of the invention in neurodegenerative disorders, the target cell may be a neuronal cell.

Typically, the target cell of the present invention expresses the XBP1 pre-mRNA, which is processed in the cell to the mature XBP1 mRNA, resulting in the expression of the both XBP1-E4 protein (also referred to as XBPu) and the XBP1Δ4 transcript variant. As described herein, in some embodiments, the compounds of the invention modulate the splicing of the XBP1 pre-mRNA to increase the proportion of XBP1 mRNA which lacks XBP1 exon 4. Suitably, thereby the expression of XBP1Δ4 transcript variant can be increased, as compared to XBP1-E4 transcript variant.

Complementarity

The term “complementarity” or “nucleobase complementarity”, which can be used interchangeably herein, describes the capacity for Watson-Crick base-pairing of nucleosides/nucleotides. Watson-Crick base pairs are guanine (G)-cytosine (C) and adenine (A)-thymine (T)/uracil (U).

It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term “% complementary” as used herein, refers to the proportion of nucleotides (in percent) of a contiguous nucleotide sequence in a nucleic acid molecule (e.g. oligonucleotide) which across the contiguous nucleotide sequence, are complementary to a reference sequence (e.g. a target sequence or sequence motif). The percentage of complementarity is thus calculated by counting the number of aligned nucleobases that are complementary (from Watson Crick base pairs) between the two sequences (when aligned with the target sequence 5'-3' and the oligonucleotide sequence from 3'-5'), dividing that number by the total number of nucleotides in the oligonucleotide and multiplying by 100. In such a comparison a nucleobase/nucleotide which does not align (form a base pair) is termed a mismatch. Insertions and deletions are not allowed in the calculation of % complementarity of a contiguous nucleotide sequence. It will be understood that in determining complementarity, chemical modifications of the nucleobases are disregarded as long as the functional capacity of the nucleobase to form Watson Crick base pairing is retained (e.g. 5'-methyl cytosine is considered identical to a cytosine for the purpose of calculating % identity).

Within the present invention the term “complementary” requires the antisense oligonucleotide to be at least about 80% complementary, or at least about 90% complementary, to a XBP1 pre-mRNA transcript. In some embodiments the antisense oligonucleotide may be at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98% or at least about 99% complementary to a hamster (SEQ ID NO 1), mouse (SEQ ID NO 590) or human (SEQ ID NO 801) XBP1 pre-mRNA transcript. Put another way, for some embodiments, an antisense oligonucleotide of the invention may include one, two, three or more mis-matches, wherein a mis-match is a nucleotide within the antisense oligonucleotide of the invention which does not base pair with its target.

The term "fully complementary" refers to 100% complementarity.

Complement

The term "complement," as used herein, indicates a sequence that is complementary to a reference sequence. It is well known that complementarity is the base principle (Watson-Crick base pairing) of DNA replication and transcription as it is a property shared between two DNA or RNA sequences, such that when they are aligned antiparallel to each other, the nucleotide bases at each position in the sequences will be complementary, much like looking in the mirror and seeing the reverse of things. Therefore, for example, the complement of a sequence of 5'-ATGC-3' can be written as 3'-TACG-5' or 5'-GCAT-3'. The terms "reverse complement", "reverse complementary", and "reverse complementarity" as used herein are interchangeable with the terms "complement", "complementary", and "complementarity."

Identity

The term "identity" as used herein, refers to the proportion of nucleotides (expressed in percent) of a contiguous nucleotide sequence in a nucleic acid molecule (e.g. oligonucleotide) which across the contiguous nucleotide sequence, are identical to a reference sequence (e.g. a sequence motif).

The percentage of identity is thus calculated by counting the number of aligned nucleobases that are identical (a Match) between two sequences (in the contiguous nucleotide sequence of the compound of the invention and in the reference sequence), dividing that number by the total number of nucleotides in the oligonucleotide and multiplying by 100. Therefore, Percentage of Identity=(Matches×100)/Length of aligned region (e.g. the contiguous nucleotide sequence). Insertions and deletions are not allowed in the calculation the percentage of identity of a contiguous nucleotide sequence. It will be understood that in determining identity, chemical modifications of the nucleobases are disregarded as long as the functional capacity of the nucleobase to form Watson Crick base pairing is retained (e.g. 5-methyl cytosine is considered identical to a cytosine for the purpose of calculating % identity).

As used herein, the terms "homologous" and "homology" are interchangeable with the terms "identity" and "identical."

Naturally Occurring Variant

The term "naturally occurring variant thereof" refers to variants of the XBP1 polypeptide sequence or XBP1 nucleic acid sequence (e.g., transcript) which exist naturally within the defined taxonomic group, such as mammalian, such as mouse, rat, Chinese hamster, monkey, and human. Typically, when referring to "naturally occurring variants" of a polynucleotide the term also can encompass any allelic variant of the XBP1-encoding genomic DNA by chromosomal translocation or duplication, and the RNA, such as mRNA derived therefrom. "Naturally occurring variants" can also include variants derived from alternative splicing of the XBP1 mRNA. When referenced to a specific polypeptide sequence, e.g., XBP1 the term also includes naturally occurring forms of the protein, which can therefore be processed, e.g., by co-or post-translational modifications, such as signal peptide cleavage, proteolytic cleavage, glycosylation, etc. In some embodiments, the naturally occurring variants have at least about 95%, at least about 96%, at least about 97%, at least about 98%, at least about 99% or more homology to a mammalian XBP1 target nucleic acid, such as that set forth in SEQ ID NO: 1 (hamster), SEQ ID NO 590 (mouse) or SEQ ID NO 801 (human). In some embodiments, the naturally occurring variants have at least 99% homology to the hamster XBP1 target nucleic acid of SEQ ID NO: 1. In some embodiments, the naturally occurring variants have at least 99% homology to the mouse XBP1 target nucleic acid of SEQ ID NO: 590. In some embodiments, the naturally occurring variants have at least 99% homology to the human XBP1 target nucleic acid of SEQ ID NO: 801.

Corresponding

The terms "corresponding to" and "corresponds to," which can be used interchangeably herein, when referencing two separate nucleic acid or nucleotide sequences can be used to clarify regions of the sequences that correspond or are similar to each other based on homology and/or functionality, although the nucleotides of the specific sequences can be numbered differently. For example, different isoforms of a gene transcript can have similar or conserved portions of nucleotide sequences whose numbering can differ in the respective isoforms based on alternative splicing and/or other modifications. In addition, it is recognized that different numbering systems can be employed when characterizing a nucleic acid or nucleotide sequence (e.g., a gene transcript and whether to begin numbering the sequence from the translation start codon or to include the 5'UTR). Further, it is recognized that the nucleic acid or nucleotide sequence of different variants of a gene or gene transcript can vary. As used herein, however, the regions of the variants that share nucleic acid or nucleotide sequence homology and/or functionality are deemed to "correspond" to one another. For example, a nucleotide sequence of a XBP1 transcript corresponding to nucleotides X to Y of SEQ ID NO: 1 ("reference sequence") refers to an XBP1 transcript sequence (e.g., XBP1 pre-mRNA or mRNA) that has an identical sequence or a similar sequence to nucleotides X to Y of SEQ ID NO: 1, wherein X is the start site and Y is the end site. A person of ordinary skill in the art can identify the corresponding X and Y residues in the XBP1 transcript sequence by aligning the XBP1 transcript sequence with SEQ ID NO: 1.

Hybridization

The terms "hybridizing" or "hybridizes" as used herein are to be understood as two nucleic acid strands (e.g. an antisense oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature (Tm) defined as the temperature at which half of the oligonucleotides are duplexed with the target nucleic acid. At physiological conditions, Tm is not strictly proportional to the affinity (Mergny and Lacroix, 2003, Oligonucleotides 13:515-537). The standard state Gibbs free energy $\Delta G°$ is a more accurate representation of binding affinity and is related to the dissociation constant (Kd) of the reaction by $\Delta G°=-RTln(Kd)$, where R is the gas constant and T is the absolute temperature. Therefore, a very low $\Delta G°$ of the reaction between an oligonucleotide and the target nucleic acid reflects. a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, Chem. Comm. 36-38 and Holdgate et al., 2005, Drug Discov Today. The skilled person will know that commercial equipment is available for $\Delta G°$ measurements. $\Delta G°$ can also be estimated numerically by using the nearest neighbour model as described by SantaLucia, 1998, *Proc Natl Acad Sci USA.* 95:1460-1465 using appropriately derived thermodynamic parameters described by Sugimoto et al., 1995, *Biochemistry* 34:11211-11216 and McTigue et al., 2004, *Biochemistry* 43:5388-5405.

In some embodiments, antisense oligonucleotides of the present invention hybridize to a target nucleic acid with estimated $\Delta G°$ values below −10 kcal for oligonucleotides that are 10-30 nucleotides in length.

In some embodiments the degree or strength of hybridization is measured by the standard state Gibbs free energy $\Delta G°$. The oligonucleotides may hybridize to a target nucleic acid with estimated $\Delta G°$ values below the range of −10 kcal, such as below −15 kcal, such as below −20 kcal and such as below −25 kcal for oligonucleotides that are 8-30 nucleotides in length. In some embodiments the oligonucleotides hybridize to a target nucleic acid with an estimated $\Delta G°$ value of −10 to −60 kcal, such as −12 to −40, such as from −15 to −30 kcal, or −16 to −27 kcal such as −18 to −25 kcal.

Transcript

The term "transcript" as used herein can refer to a primary transcript that is synthesized by transcription of DNA and becomes a messenger RNA (mRNA) after processing, i.e., a precursor messenger RNA (pre-mRNA), and the processed mRNA itself. The term "transcript" can be interchangeably used with "pre-mRNA" and "mRNA." After DNA strands are transcribed to primary transcripts, the newly synthesized primary transcripts are modified in several ways to be converted to their mature, functional forms to produce different proteins and RNAs such as mRNA, tRNA, rRNA, lncRNA, miRNA and others. Thus, the term "transcript" can include exons, introns, 5'-UTRs, and 3'-UTRs.

Expression

The term "expression" as used herein refers to a process by which a polynucleotide produces a gene product, for example, a RNA or a polypeptide. It includes, without limitation, transcription of the polynucleotide into messenger RNA (mRNA) and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

Compound Number

The term "Compound Number" or "Comp No." as used herein refers to a unique number given to a nucleotide sequence having the detailed chemical structure of the components, e.g., nucleosides (e.g., DNA), nucleoside analogs (e.g., LNA, e.g., beta-D-oxy-LNA), nucleobase (e.g., A, T, G, C, U, or MC), and backbone structure (e.g., phosphorothioate or phosphorodiester).

A reference to a SEQ ID number includes a particular nucleic acid sequence but does not include any design or full chemical structure. Furthermore, the antisense oligonucleotide sequences disclosed in the examples herein show a representative design but are not limited to the specific design shown unless otherwise indicated.

The Subject

By "subject" or "individual" or "animal" or "patient" or "mammal," is meant any subject, particularly a mammalian subject, for whom diagnosis, prognosis, or therapy is desired. Mammalian subjects include humans, domestic animals, farm animals, sports animals, and zoo animals including, e.g., humans, non-human primates, dogs, cats, guinea pigs, rabbits, rats, mice, horses, cattle, bears, and so on. In some embodiments, the subject is a human.

In some embodiments, the subject is a human who is suffering from a proteopathological diseases, or is at risk of developing a proteopathological disease.

Pharmaceutical Composition

The term "pharmaceutical composition" refers to a preparation which is in such form as to permit the biological activity of the active ingredient to be effective, and which contains no additional components which are unacceptably toxic to a subject to which the composition would be administered. Such compositions can be sterile.

Proteopathological Diseases

Proteopathological diseases (also known as proteopathies, proteinopathies, protein conformational disorders, or protein misfolding diseases) include such diseases as prion diseases e.g. Creutzfeldt-Jakob disease; tauopathies, such as Alzheimer's disease; synucleinopathies such as Parkinson's disease; amyloidosis, multiple system atrophy; and TDP-43 pathologies, such as amyotrophic lateral sclerosis (ALS) frontotemporal lobar degeneration (FTLD); CAG repeat indications, such as spinocerebellar ataxias, such as spinocerebellar ataxia type 1, Spinocerebellar ataxia type 2 (SCA2), and Spinocerebellar ataxia type 3 (SCA3, Machado-Joseph disease).

Effective Amount

An "effective amount" of a composition disclosed herein (e.g., a composition comprising a compound, such as an antisense oligonucleotide, or conjugate or salt thereof) refers to an amount sufficient to carry out a specifically stated purpose. An "effective amount" can be determined empirically and in a routine manner, in relation to the stated purpose.

Treatment

Terms such as "treating" or "treatment" or "to treat" or "alleviating" or "to alleviate" refer to both (1) therapeutic measures that cure, slow down, lessen symptoms of, and/or halt progression of a diagnosed pathologic condition or disorder and (2) prophylactic or preventative measures that prevent and/or slow the development of a targeted pathologic condition or disorder, such as a proteopathological disease. Thus, those in need of treatment include those already with the disorder, those prone to have the disorder and those in whom the disorder is to be prevented. In certain embodiments, a subject is successfully "treated" for a disease or condition disclosed elsewhere herein according to the methods provided herein if the patient shows, e.g., total, partial, or transient alleviation or elimination of symptoms associated with the disease or disorder.

Antibodies

General information regarding the nucleotide sequences of human immunoglobulins light and heavy chains is given in: Kabat, E. A., et al., Sequences of Proteins of Immunological Interest, 5th ed., Public Health Service, National Institutes of Health, Bethesda, MD (1991).

As used herein, the amino acid positions of all constant regions and domains of the heavy and light chain are numbered according to the Kabat numbering system described in Kabat, et al., Sequences of Proteins of Immunological Interest, 5th ed., Public Health Service, National Institutes of Health, Bethesda, MD (1991) and is referred to as "numbering according to Kabat" herein. Specifically, the Kabat numbering system (see pages 647-660) of Kabat, et al., Sequences of Proteins of Immunological Interest, 5th ed., Public Health Service, National Institutes of Health, Bethesda, MD (1991) is used for the light chain constant domain CL of kappa and lambda isotype, and the Kabat EU index numbering system (see pages 661-723) of Kabat, et al., Sequences of Proteins of Immunological Interest, 5th ed., Public Health Service, National Institutes of Health, Bethesda, MD (1991) is used for the constant heavy chain domains (CH1, hinge, CH2 and CH3, which is herein further clarified by referring to "numbering according to Kabat EU index" in this case).

The term "antibody" herein is used in the broadest sense and encompasses various antibody structures, including but not limited to full length antibodies, monoclonal antibodies, multispecific antibodies (e.g., bispecific antibodies), and antibody-antibody fragment-fusions as well as combinations thereof.

Native Antibody

The term "native antibody" denotes naturally occurring immunoglobulin molecules with varying structures. For example, native IgG antibodies are heterotetrameric glycoproteins of about 150,000 Daltons, composed of two identical light chains and two identical heavy chains that are disulfide-bonded. From N- to C-terminus, each heavy chain has a heavy chain variable region (VH) followed by three heavy chain constant domains (CH1, CH2, and CH3), whereby between the first and the second heavy chain constant domain a hinge region is located. Similarly, from N- to C-terminus, each light chain has a light chain variable region (VL) followed by a light chain constant domain (CL). The light chain of an antibody may be assigned to one of two types, called kappa (κ) and lambda (Λ), based on the amino acid sequence of its constant domain.

Full Length Antibody

The term "full length antibody" denotes an antibody having a structure substantially similar to that of a native antibody. A full length antibody comprises two full length antibody light chains each comprising in N- to C-terminal direction a light chain variable region and a light chain constant domain, as well as two full length antibody heavy chains each comprising in N- to C-terminal direction a heavy chain variable region, a first heavy chain constant domain, a hinge region, a second heavy chain constant domain and a third heavy chain constant domain. In contrast to a native antibody, a full length antibody may comprise further immunoglobulin domains, such as e.g. one or more additional scFvs, or heavy or light chain Fab fragments, or scFabs conjugated to one or more of the termini of the different chains of the full length antibody, but only a single fragment to each terminus. These conjugates are also encompassed by the term full-length antibody.

Antibody Binding Site

The term "antibody binding site" denotes a pair of a heavy chain variable domains and a light chain variable domain. To ensure proper binding to the antigen these variable domains are cognate variable domains, i.e. belong together. An antibody binding site comprises at least three HVRs (e.g. in case of a VHH) or three-six HVRs (e.g. in case of a naturally occurring, i.e. conventional, antibody with a VH/VL pair). Generally, the amino acid residues of an antibody that are responsible for antigen binding form the binding site. These residues are normally contained in a pair of an antibody heavy chain variable domain and a corresponding antibody light chain variable domain. The antigen-binding site of an antibody comprises amino acid residues from the "hypervariable regions" or "HVRs". "Framework" or "FR" regions are those variable domain regions other than the hypervariable region residues as herein defined. Therefore, the light and heavy chain variable domains of an antibody comprise from N- to C-terminus the regions FR1, HVR1, FR2, HVR2, FR3, HVR3 and FR4. Especially, the HVR3 region of the heavy chain variable domain is the region, which contributes most to antigen binding and defines the binding specificity of an antibody. A "functional binding site" is capable of specifically binding to its target. The term "specifically binding to" denotes the binding of a binding site to its target in an in vitro assay, in one embodiment in a binding assay. Such binding assay can be any assay as long the binding event can be detected. For example, an assay in which the antibody is bound to a surface and binding of the antigen(s) to the antibody is measured by Surface Plasmon Resonance (SPR). Alternatively, a bridging ELISA can be used.

Hypervariable Region

The term "hypervariable region" or "HVR", as used herein, refers to each of the regions of an antibody variable domain comprising the amino acid residue stretches which are hypervariable in sequence ("complementarity determining regions" or "CDRs") and/or form structurally defined loops ("hypervariable loops"), and/or contain the antigen-contacting residues ("antigen contacts"). Generally, antibodies comprise six HVRs; three in the heavy chain variable domain VH (H1, H2, H3), and three in the light chain variable domain VL (L1, L2, L3).

HVRs Include (a) hypervariable loops occurring at amino acid residues 26-32 (L1), 50-52 (L2), 91-96 (L3), 26-32 (H1), 53-55 (H2), and 96-101 (H3) (Chothia, C. and Lesk, A. M., J. Mol. Biol. 196 (1987) 901-917);

(b) CDRs occurring at amino acid residues 24-34 (L1), 50-56 (L2), 89-97 (L3), 31-35b (H1), 50-65 (H2), and 95-102 (H3) (Kabat, E. A. et al., Sequences of Proteins of Immunological Interest, 5th ed. Public Health Service, National Institutes of Health, Bethesda, MD (1991), NIH Publication 91-3242.);

(c) antigen contacts occurring at amino acid residues 27c-36 (L1), 46-55 (L2), 89-96 (L3), 30-35b (H1), 47-58 (H2), and 93-101 (H3) (MacCallum et al. J. Mol. Biol. 262:732-745 (1996)); and (d) combinations of (a), (b), and/or (c), including amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR residues and other residues in the variable domain (e.g., FR residues) are numbered herein according to Kabat et al., supra.

Antibody Class

The "class" of an antibody refers to the type of constant domains or constant region, preferably the Fc-region, possessed by its heavy chains. There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called a, δ, ε, γ, and μ, respectively.

Heavy Chain Constant Region

The term "heavy chain constant region" denotes the region of an immunoglobulin heavy chain that contains the constant domains, i.e. the CH1 domain, the hinge region, the CH2 domain and the CH3 domain. In one embodiment, a human IgG constant region extends from Ala118 to the carboxyl-terminus of the heavy chain (numbering according to Kabat EU index). However, the C-terminal lysine (Lys447) of the constant region may or may not be present (numbering according to Kabat EU index). The term "constant region" denotes a dimer comprising two heavy chain constant regions, which can be covalently linked to each other via the hinge region cysteine residues forming inter-chain disulfide bonds.

Heavy Chain Fc-Region

The term "heavy chain Fc-region" denotes the C-terminal region of an immunoglobulin heavy chain that contains at least a part of the hinge region (middle and lower hinge region), the CH2 domain and the CH3 domain. In one embodiment, a human IgG heavy chain Fc-region extends from Asp221, or from Cys226, or from Pro230, to the carboxyl-terminus of the heavy chain (numbering according to Kabat EU index). Thus, an Fc-region is smaller than a constant region but in the C-terminal part identical thereto. However, the C-terminal lysine (Lys447) of the heavy chain Fc-region may or may not be present (numbering according to Kabat EU index). The term "Fc-region" denotes a dimer comprising two heavy chain Fc-regions, which can be covalently linked to each other via the hinge region cysteine residues forming inter-chain disulfide bonds.

The constant region, more precisely the Fc-region, of an antibody (and the constant region likewise) is directly involved in complement activation, C1q binding, C3 activation and Fc receptor binding. While the influence of an antibody on the complement system is dependent on certain conditions, binding to Clq is caused by defined binding sites in the Fc-region. Such binding sites are known in the state of the art and described e.g. by Lukas, T. J., et al., J. Immunol. 127 $(1981)_{2555}$-2560; Brunhouse, R., and Cebra, J.J., Mol. Immunol. 16 (1979) 907-917; Burton, D. R., et al., Nature 288 (1980) 338-344; Thommesen, J. E., et al., Mol. Immunol. 37 (2000) 995-1004; Idusogie, E. E., et al., J. Immunol. 164 (2000) 4178-4184; Hezareh, M., et al., J. Virol. 75 (2001) 12161-12168; Morgan, A., et al., Immunology 86 (1995) 319-324; and EP 0 307 434. Such binding sites are e.g. L234, L235, D270, N297, E318, K320, K322, P331 and P329 (numbering according to EU index of Kabat). Antibodies of subclass IgG1, IgG2 and IgG3 usually show complement activation, Clq binding and C3 activation, whereas IgG4 do not activate the complement system, do not bind C1q and do not activate C3. An "Fc-region of an antibody" is a term well known to the skilled artisan and defined on the basis of papain cleavage of antibodies.

Monoclonal Antibody

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, monoclonal antibodies may be made by a variety of techniques, including but not limited to the hybridoma method, recombinant DNA methods, phage-display methods, and methods utilizing transgenic animals containing all or part of the human immunoglobulin loci.

Valent

The term "valent" as used within the current application denotes the presence of a specified number of binding sites in an antibody. As such, the terms "bivalent", "tetravalent", and "hexavalent" denote the presence of two binding site, four binding sites, and six binding sites, respectively, in an antibody.

Monospecific Antibody

A "monospecific antibody" denotes an antibody that has a single binding specificity, i.e. specifically binds to one antigen. Monospecific antibodies can be prepared as full-length antibodies or antibody fragments (e.g. $F(ab')_2$) or combinations thereof (e.g. full length antibody plus additional scFv or Fab fragments). A monospecific antibody does not need to be monovalent, i.e. a monospecific antibody may comprise more than one binding site specifically binding to the one antigen. A native antibody, for example, is monospecific but bivalent.

Multispecific Antibody

A "multispecific antibody" denotes an antibody that has binding specificities for at least two different epitopes on the same antigen or two different antigens. Multispecific antibodies can be prepared as full-length antibodies or antibody fragments (e.g. $F(ab')_2$ bispecific antibodies) or combinations thereof (e.g. full length antibody plus additional scFv or Fab fragments). A multispecific antibody is at least bivalent, i.e. comprises two antigen binding sites. In addition, a multispecific antibody is at least bispecific. Thus, a bivalent, bispecific antibody is the simplest form of a multispecific antibody. Engineered antibodies with two, three or more (e.g. four) functional antigen binding sites have also been reported (see, e.g., US 2002/0004587).

In certain embodiments, the antibody is a multispecific antibody, e.g. at least a bispecific antibody. Multispecific antibodies are monoclonal antibodies that have binding specificities for at least two different antigens or epitopes. In certain embodiments, one of the binding specificities is for a first antigen and the other is for a different second antigen. In certain embodiments, multispecific antibodies may bind to two different epitopes of the same antigen. Multispecific antibodies may also be used to localize cytotoxic agents to cells, which express the antigen.

Multispecific antibodies can be prepared as full-length antibodies or antibody-antibody fragment-fusions.

Techniques for making multispecific antibodies include, but are not limited to, recombinant co-expression of two immunoglobulin heavy chain-light chain pairs having different specificities (see Milstein, C. and Cuello, A.C., Nature 305 (1983) 537-540, WO 93/08829, and Traunecker, A., et al., EMBO J. 10 (1991) 3655-3659), and "knob-in-hole" engineering (see, e.g., U.S. Pat. No. 5,731,168). Multispecific antibodies may also be made by engineering electrostatic steering effects for making antibody Fc-heterodimeric molecules (WO 2009/089004); cross-linking two or more antibodies or fragments (see, e.g., U.S. Pat. No. 4,676,980, and Brennan, M., et al., Science 229 (1985) 81-83); using leucine zippers to produce bi-specific antibodies (see, e.g., Kostelny, S. A., et al., J. Immunol. 148 (1992)

1547-1553); using the common light chain technology for circumventing the light chain mis-pairing problem (see, e.g., WO 98/50431); using specific technology for making bispecific antibody fragments (see, e.g., Holliger, P., et al., Proc. Natl. Acad. Sci. USA 90 (1993) 6444-6448); and preparing trispecific antibodies as described, e.g., in Tutt, A., et al., J. Immunol. 147 (1991) 60-69).

Engineered antibodies with three or more antigen binding sites, including for example, "Octopus antibodies", or DVD-Ig are also included herein (see, e.g., WO 2001/77342 and WO 2008/024715). Other examples of multispecific antibodies with three or more antigen binding sites can be found in WO 2010/115589, WO 2010/112193, WO 2010/136172, WO 2010/145792, and WO 2013/026831. The bispecific antibody or antigen binding fragment thereof also includes a "Dual Acting Fab" or "DAF" (see, e.g., US 2008/0069820 and WO 2015/095539).

Multi-specific antibodies may also be provided in an asymmetric form with a domain crossover in one or more binding arms of the same antigen specificity, i.e. by exchanging the VH/VL domains (see, e.g., WO 2009/080252 and WO 2015/150447), the CH1/CL domains (see, e.g., WO 2009/080253) or the complete Fab arms (see e.g., WO 2009/080251, WO 2016/016299, also see Schaefer et al., Proc. Natl. Acad. Sci. USA 108 (2011) 1187-1191, and Klein at a1., MAbs 8 (2016) 1010-1020). In one aspect, the multispecific antibody comprises a Cross-Fab fragment. The term "Cross-Fab fragment" or "xFab fragment" or "crossover Fab fragment" refers to a Fab fragment, wherein either the variable regions or the constant regions of the heavy and light chain are exchanged. A Cross-Fab fragment comprises a polypeptide chain composed of the light chain variable region (VL) and the heavy chain constant region 1 (CH1), and a polypeptide chain composed of the heavy chain variable region (VH) and the light chain constant region (CL). Asymmetrical Fab arms can also be engineered by introducing charged or non-charged amino acid mutations into domain interfaces to direct correct Fab pairing. See e.g., WO 2016/172485.

The antibody or fragment can also be a multispecific antibody as described in WO 2009/080254, WO 2010/112193, WO 2010/115589, WO 2010/136172, WO 2010/145792, or WO 2010/145793.

The antibody or fragment thereof may also be a multispecific antibody as disclosed in WO 2012/163520.

Various further molecular formats for multispecific antibodies are known in the art and are included herein (see e.g., Spiess et al., Mol. Immunol. 67 (2015) 95-106).

Bispecific antibodies are generally antibody molecules that specifically bind to two different, non-overlapping epitopes on the same antigen or to two epitopes on different antigens.

Complex (multispecific) antibodies are a full-length antibody with domain exchange:

a multispecific IgG antibody comprising a first Fab fragment and a second Fab fragment, wherein in the first Fab fragment a) only the CH1 and CL domains are replaced by each other (i.e. the light chain of the first Fab fragment comprises a VL and a CH1 domain and the heavy chain of the first Fab fragment comprises a VH and a CL domain); b) only the VH and VL domains are replaced by each other (i.e. the light chain of the first Fab fragment comprises a VH and a CL domain and the heavy chain of the first Fab fragment comprises a VL and a CH1 domain); or c) the CH1 and CL domains are replaced by each other and the VH and VL domains are replaced by each other (i.e. the light chain of the first Fab fragment comprises a VH and a CH1 domain and the heavy chain of the first Fab fragment comprises a VL and a CL domain); and wherein the second Fab fragment comprises a light chain comprising a VL and a CL domain, and a heavy chain comprising a VH and a CH1 domain;

the full-length antibody with domain exchange may comprises a first heavy chain including a CH3 domain and a second heavy chain including a CH3 domain, wherein both CH3 domains are engineered in a complementary manner by respective amino acid substitutions, in order to support heterodimerization of the first heavy chain and the modified second heavy chain, e.g. as disclosed in WO 96/27011, WO 98/050431, EP 1870459, WO 2007/110205, WO 2007/147901, WO 2009/089004, WO 2010/129304, WO 2011/90754, WO 2011/143545, WO 2012/058768, WO 2013/157954, or WO 2013/096291 (incorporated herein by reference);

a full-length antibody with domain exchange and additional heavy chain C-terminal binding site:

a multispecific IgG antibody comprising a) one full length antibody comprising two pairs each of a full length antibody light chain and a full length antibody heavy chain, wherein the binding sites formed by each of the pairs of the full length heavy chain and the full length light chain specifically bind to a first antigen, and b) one additional Fab fragment, wherein the additional Fab fragment is fused to the C-terminus of one heavy chain of the full length antibody, wherein the binding site of the additional Fab fragment specifically binds to a second antigen, wherein the additional Fab fragment specifically binding to the second antigen i) comprises a domain crossover such that a) the light chain variable domain (VL) and the heavy chain variable domain (VH) are replaced by each other, or b) the light chain constant domain (CL) and the heavy chain constant domain (CH1) are replaced by each other, or ii) is a single chain Fab fragment;

the one-armed single chain format (=one-armed single chain antibody):

antibody comprising a first binding site that specifically binds to a first epitope or antigen and a second binding site that specifically binds to a second epitope or antigen, whereby the individual chains are as follows light chain (variable light chain domain+light chain kappa constant domain)

combined light/heavy chain (variable light chain domain+light chain constant domain+peptidic linker+variable heavy chain domain+CH1+Hinge+CH2+CH3 with knob mutation)

heavy chain (variable heavy chain domain+CH1+Hinge+CH2+CH3 with hole mutation);

a two-armed single chain antibody:

antibody comprising a first binding site that specifically binds to a first epitope or antigen and a second binding site that specifically binds to a second epitope or antigen, whereby the individual chains are as follows combined light/heavy chain 1 (variable light chain domain+light chain constant domain+peptidic linker+variable heavy chain domain+CH1+Hinge+CH2+CH3 with hole mutation)

combined light/heavy chain 2 (variable light chain domain+light chain constant domain+peptidic linker+variable heavy chain domain+CH1+Hinge+CH2+CH3 with knob mutation);

a common light chain bispecific antibody:

antibody comprising a first binding site that specifically binds to a first epitope or antigen and a second binding site that specifically binds to a second epitope or antigen, whereby the individual chains are as follows light chain (variable light chain domain+light chain constant domain)

heavy chain 1 (variable heavy chain domain+CH1+Hinge+CH2+CH3 with hole mutation)

heavy chain 2 (variable heavy chain domain+CH1+Hinge+CH2+CH3 with knob mutation);

a T-cell bispecific antibody:

a full-length antibody with additional heavy chain N-terminal binding site with domain exchange comprising a first and a second Fab fragment, wherein each binding site of the first and the second Fab fragment specifically bind to a first antigen, a third Fab fragment, wherein the binding site of the third Fab fragment specifically binds to a second antigen, and wherein the third Fab fragment comprises a domain crossover such that the variable light chain domain (VL) and the variable heavy chain domain (VH) are replaced by each other, and an Fc-region comprising a first Fc-region polypeptide and a second Fc-region polypeptide, wherein the first and the second Fab fragment each comprise a heavy chain fragment and a full-length light chain, wherein the C-terminus of the heavy chain fragment of the first Fab fragment is fused to the N-terminus of the first Fc-region polypeptide, wherein the C-terminus of the heavy chain fragment of the second Fab fragment is fused to the N-terminus of the variable light chain domain of the third Fab fragment and the C-terminus of the CH1 domain of the third Fab fragment is fused to the N-terminus of the second Fc-region polypeptide;

an antibody-multimer-fusions comprising (a) an antibody heavy chain and an antibody light chain, and (b) a first fusion polypeptide comprising in N- to C-terminal direction a first part of a non-antibody multimeric polypeptide, an antibody heavy chain CH1 domain or an antibody light chain constant domain, an antibody hinge region, an antibody heavy chain CH2 domain and an antibody heavy chain CH3 domain, and a second fusion polypeptide comprising in N- to C-terminal direction the second part of the non-antibody multimeric polypeptide and an antibody light chain constant domain if the first polypeptide comprises an antibody heavy chain CH1 domain or an antibody heavy chain CH1 domain if the first polypeptide comprises an antibody light chain constant domain, wherein (i) the antibody heavy chain of (a) and the first fusion polypeptide of (b), (ii) the antibody heavy chain of (a) and the antibody light chain of (a), and (iii) the first fusion polypeptide of (b) and the second fusion polypeptide of (b) are each independently of each other covalently linked to each other by at least one disulfide bond, wherein the variable domains of the antibody heavy chain and the antibody light chain form a binding site specifically binding to an antigen.

The "knobs into holes" dimerization modules and their use in antibody engineering are described in Carter P.; Ridgway J. B. B.; Presta L. G.: Immunotechnology, Volume 2, Number 1, February 1996, pp. 73-73 (1).

The CH3 domains in the heavy chains of an antibody can be altered by the "knob-into-holes" technology, which is described in detail with several examples in e.g. WO 96/027011, Ridgway, J. B., et al., Protein Eng. 9 (1996) 617-621; and Merchant, A. M., et al., Nat. Biotechnol. 16 (1998) 677-681. In this method, the interaction surfaces of the two CH3 domains are altered to increase the heterodimerization of these two CH3 domains and thereby of the polypeptide comprising them. Each of the two CH3 domains (of the two heavy chains) can be the "knob", while the other is the "hole". The introduction of a disulfide bridge further stabilizes the heterodimers (Merchant, A. M., et al., Nature Biotech. 16 (1998) 677-681; Atwell, S., et al., J. Mol. Biol. 270 $(1997)_{26}$-35) and increases the yield.

The mutation T366W in the CH3 domain (of an antibody heavy chain) is denoted as "knob-mutation" or "mutation knob" and the mutations T366S, L368A, Y407V in the CH3 domain (of an antibody heavy chain) are denoted as "hole-mutations" or "mutations hole" (numbering according to Kabat EU index). An additional inter-chain disulfide bridge between the CH3 domains can also be used (Merchant, A. M., et al., Nature Biotech. 16 (1998) 677-681) e.g. by introducing a S354C mutation into the CH3 domain of the heavy chain with the "knob-mutation" (denotes as "knob-cys-mutations" or "mutations knob-cys") and by introducing a Y349C mutation into the CH3 domain of the heavy chain with the "hole-mutations" (denotes as "hole-cys-mutations" or "mutations hole-cys") (numbering according to Kabat EU index).

Domain Crossover

The term "domain crossover" as used herein denotes that in a pair of an antibody heavy chain VH-CH1 fragment and its corresponding cognate antibody light chain, i.e. in an antibody Fab (fragment antigen binding), the domain sequence deviates from the sequence in a native antibody in that at least one heavy chain domain is substituted by its corresponding light chain domain and vice versa. There are three general types of domain crossovers, (i) the crossover of the CH1 and the CL domains, which leads by the domain crossover in the light chain to a VL-CH1 domain sequence and by the domain crossover in the heavy chain fragment to a VH-CL domain sequence (or a full length antibody heavy chain with a VH-CL-hinge-CH2-CH3 domain sequence), (ii) the domain crossover of the VH and the VL domains, which leads by the domain crossover in the light chain to a VH-CL domain sequence and by the domain crossover in the heavy chain fragment to a VL-CH1 domain sequence, and (iii) the domain crossover of the complete light chain (VL-CL) and the complete VH-CH1 heavy chain fragment ("Fab crossover"), which leads to by domain crossover to a light chain with a VH-CH1 domain sequence and by domain crossover to a heavy chain fragment with a VL-CL domain sequence (all aforementioned domain sequences are indicated in N-terminal to C-terminal direction).

Replaced by Each Other

As used herein the term "replaced by each other" with respect to corresponding heavy and light chain domains refers to the aforementioned domain crossovers. As such, when CH1 and CL domains are "replaced by each other" it is referred to the domain crossover mentioned under item (i)

and the resulting heavy and light chain domain sequence. Accordingly, when VH and VL are "replaced by each other" it is referred to the domain crossover mentioned under item (ii); and when the CH1 and CL domains are "replaced by each other" and the VH and VL domains are "replaced by each other" it is referred to the domain crossover mentioned under item (iii). Bispecific antibodies including domain crossovers are reported, e.g. in WO 2009/080251, WO 2009/080252, WO 2009/080253, WO 2009/080254 and Schaefer, W., et al, Proc. Natl. Acad. Sci. USA 108 (2011) 11187-11192. Such antibodies are generally termed CrossMab.

Multispecific antibodies also comprise in one embodiment at least one Fab fragment including either a domain crossover of the CH1 and the CL domains as mentioned under item (i) above, or a domain crossover of the VH and the VL domains as mentioned under item (ii) above, or a domain crossover of the VH-CH1 and the VL-VL domains as mentioned under item (iii) above. In case of multispecific antibodies with domain crossover, the Fabs specifically binding to the same antigen(s) are constructed to be of the same domain sequence. Hence, in case more than one Fab with a domain crossover is contained in the multispecific antibody, said Fab(s) specifically bind to the same antigen.

Humanized

A "humanized" antibody refers to an antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., the CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

Recombinant Antibody

The term "recombinant antibody", as used herein, denotes all antibodies (chimeric, humanized and human) that are prepared, expressed, created or isolated by recombinant means, such as recombinant cells. This includes antibodies isolated from recombinant cells such as NSO, HEK, BHK, amniocyte or CHO cells.

Antibody Fragment

As used herein, the term "antibody fragment" refers to a molecule other than an intact antibody that comprises a portion of an intact antibody that binds the antigen to which the intact antibody binds, i.e. it is a functional fragment. Examples of antibody fragments include but are not limited to Fv; Fab; Fab'; Fab'-SH; $F(ab')_2$; bispecific Fab; diabodies; linear antibodies; single-chain antibody molecules (e.g., scFv or scFab).

Recombinant Methods

Antibodies may be produced using recombinant methods and compositions, e.g., as described in U.S. Pat. No. 4,816,567. For these methods, one or more isolated nucleic acid(s) encoding an antibody are provided.

In one aspect, a method of making an antibody is provided, wherein the method comprises culturing a host cell comprising nucleic acid(s) encoding the antibody, as provided above, under conditions suitable for expression of the antibody, and optionally recovering the antibody from the host cell (or host cell culture medium), wherein at least one cultivation step is in the presence of a compound according to the invention.

For recombinant production of an antibody, nucleic acids encoding the antibody, e.g., as described above, are isolated and inserted into one or more vectors for further cloning and/or expression in a host cell. Such nucleic acids may be readily isolated and sequenced using conventional procedures (e.g., by using oligonucleotide probes that are capable of binding specifically to genes encoding the heavy and light chains of the antibody) or produced by recombinant methods or obtained by chemical synthesis.

Recombinant Mammalian Cell

Generally, for the recombinant large-scale production of a polypeptide of interest, such as e.g. a therapeutic antibody, a cell stably expressing and secreting said polypeptide is required.

This cell is a "recombinant mammalian cell" or "recombinant production cell" and the process used for generating such a cell is termed "cell line development". In the first step of the cell line development process, a suitable host cell, such as e.g. a CHO cell, is transfected with a nucleic acid sequence suitable for expression of said polypeptide of interest. In a second step, a cell stably expressing the polypeptide of interest is selected based on the co-expression of a selection marker, which had been co-transfected with the nucleic acid encoding the polypeptide of interest.

A nucleic acid encoding a polypeptide, i.e. the coding sequence, is denoted as a structural gene. Such a structural gene is pure coding information. Thus, additional regulatory elements are required for expression thereof. Therefore, normally a structural gene is integrated in a so-called expression cassette. The minimal regulatory elements needed for an expression cassette to be functional in a mammalian cell are a promoter functional in said mammalian cell, which is located upstream, i.e. 5', to the structural gene, and a polyadenylation signal sequence functional in said mammalian cell, which is located downstream, i.e. 3', to the structural gene. The promoter, the structural gene and the polyadenylation signal sequence are arranged in an operably linked form.

In case the polypeptide of interest is a heteromultimeric polypeptide that is composed of different (monomeric) polypeptides, such as e.g. an antibody or a complex antibody format, not only a single expression cassette is required but a multitude of expression cassettes differing in the contained structural gene, i.e. at least one expression cassette for each of the different (monomeric) polypeptides of the heteromultimeric polypeptide. For example, a full-length antibody is a heteromultimeric polypeptide comprising two copies of a light chain as well as two copies of a heavy chain. Thus, a full-length antibody is composed of two different polypeptides. Therefore, two expression cassettes are required for the expression of a full-length antibody, one for the light chain and one for the heavy chain. If, for example, the full-length antibody is a bispecific antibody, i.e. the antibody comprises two different binding sites specifically binding to two different antigens, the two light chains as well as the two heavy chains are also different from each other. Thus, such a bispecific, full-length antibody is composed of four different polypeptides and therefore, four expression cassettes are required.

Expression Vector

The expression cassette(s) for the polypeptide of interest is (are) generally integrated into one or more so called "expression vector(s)". An "expression vector" is a nucleic acid providing all required elements for the amplification of said vector in bacterial cells as well as the expression of the comprised structural gene(s) in a mammalian cell. Typically, an expression vector comprises a prokaryotic plasmid propagation unit, e.g. for *E. coli*, comprising an origin of replication, and a prokaryotic selection marker, as well as a eukaryotic selection marker, and the expression cassettes required for the expression of the structural gene(s) of interest. An "expression vector" is a transport vehicle for the introduction of expression cassettes into a mammalian cell.

The more complex the polypeptide to be expressed is the higher also the number of required different expression cassettes is. Inherently with the number of expression cassettes also the size of the nucleic acid to be integrated into the genome of the host cell increases. Concomitantly also the size of the expression vector increases. However, there is a practical upper limit to the size of a vector in the range of about 15 kbps above which handling and processing efficiency profoundly drops. This issue can be addressed by using two or more expression vectors. Thereby the expression cassettes can be split between different expression vectors each comprising only some of the expression cassettes resulting in a size reduction.

Cell Line Development

Cell line development (CLD) for the generation of recombinant cell expressing a heterologous polypeptide, such as e.g. a multispecific antibody, employs either random integration (RI) or targeted integration (TI) of the nucleic acid(s) comprising the respective expression cassettes required for the expression and production of the heterologous polypeptide of interest.

Using RI, in general, several vectors or fragments thereof integrate into the cell's genome at the same or different loci.

Using TI, in general, a single copy of the transgene comprising the different expression cassettes is integrated at a predetermined "hot-spot" in the host cell's genome.

Unlike RI CLD, targeted integration (TI) CLD introduces the transgene comprising the different expression cassettes at a predetermined "hot-spot" in a cell's genome. Also the introduction is with a defined ratio of the expression cassettes. Thereby, without being bound by this theory, all the different polypeptides of the heteromultimeric polypeptide are expressed at the same (or at least a comparable and only slightly differing) rate and at an appropriate ratio.

Also, given the defined copy number and the defined integration site, recombinant cells obtained by TI should have better stability compared to cells obtained by RI. Moreover, since the selection marker is only used for selecting cells with proper TI and not for selecting cells with a high level of transgene expression, a less mutagenic marker may be applied to minimize the chance of sequence variants (SVs), which is in part due to the mutagenicity of the selective agents like methotrexate (MTX) or methionine sulfoximine (MSX).

Suitable host cells for the expression of an (glycosylated) antibody are generally derived from multicellular organisms such as e.g. vertebrates.

Host cells.-Any mammalian cell line that is adapted to grow in suspension can be used in the method according to the current invention. In addition, independent from the integration method, i.e. for RI as well as TI, any mammalian host cell can be used.

Examples of useful mammalian host cell lines are human amniocyte cells (e.g. CAP-T cells as described in Woelfel, J. et al., BMC Proc. 5 (2011) P133); monkey kidney CV1 line transformed by SV40 (COS-7); human embryonic kidney line (HEK293 or HEK293T cells as described, e.g., in Graham, F. L. et al., J. Gen Virol. 36 (1977) 59-74); baby hamster kidney cells (BHK); mouse sertoli cells (TM4 cells as described, e.g., in Mather, J.P., Biol. Reprod. 23 (1980) 243-252); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells (as described, e.g., in Mather, J. P. et al., Annals N.Y. Acad. Sci. 383 (1982) 44-68); MRC 5 cells; and FS4 cells. Other useful mammalian host cell lines include Chinese hamster ovary (CHO) cells, including DHFR-CHO cells (Urlaub, G. et al., Proc. Natl. Acad. Sci. USA 77 (1980) 4216-4220); and myeloma cell lines such as YO, NSO and Sp2/0.

For a review of certain mammalian host cell lines suitable for antibody production, see, e.g., Yazaki, P. and Wu, A. M., Methods in Molecular Biology, Vol. 248, Lo, B. K. C. (ed.), Humana Press, Totowa, NJ (2004), pp. 255-268.

In one embodiment, the mammalian host cell is, e.g., a Chinese Hamster Ovary (CHO) cell (e.g. CHO K1, CHO DG44, etc.), a Human Embryonic Kidney (HEK) cell, a lymphoid cell (e.g., YO, NSO, Sp2/0 cell), or a human amniocyte cells (e.g. CAP-T, etc.). In one preferred embodiment, the mammalian (host) cell is a CHO cell.

Targeted integration allows exogenous nucleotide sequences to be integrated into a pre-determined site of a mammalian cell's genome. In certain embodiments, the targeted integration is mediated by a recombinase that recognizes one or more recombination recognition sequences (RRSs), which are present in the genome and in the exogenous nucleotide sequence to be integrated. In certain embodiments, the targeted integration is mediated by homologous recombination.

Recombination Recognition Sequence

A "recombination recognition sequence" (RRS) is a nucleotide sequence recognized by a recombinase and is necessary and sufficient for recombinase-mediated recombination events. A RRS can be used to define the position where a recombination event will occur in a nucleotide sequence.

In certain embodiments, a RRS can be recognized by a Cre recombinase. In certain embodiments, a RRS can be recognized by a FLP recombinase. In certain embodiments, a RRS can be recognized by a Bxb1 integrase. In certain embodiments, a RRS can be recognized by a φC31 integrase.

In certain embodiments when the RRS is a LoxP site, the cell requires the Cre recombinase to perform the recombination. In certain embodiments when the RRS is a FRT site, the cell requires the FLP recombinase to perform the recombination. In certain embodiments when the RRS is a Bxb1 attP or a Bxb1 attB site, the cell requires the Bxb1 integrase to perform the recombination. In certain embodiments when the RRS is a φC31 attP or a φC31 attB site, the cell requires the φC31 integrase to perform the recombination. The recombinases can be introduced into a cell using an expression vector comprising coding sequences of the enzymes or as protein or a mRNA.

With respect to TI, any known or future mammalian host cell suitable for TI comprising a landing site as described herein integrated at a single site within a locus of the genome can be used in the current invention. Such a cell is denoted as mammalian TI host cell. In certain embodiments, the mammalian TI host cell is a hamster cell, a human cell, a rat cell, or a mouse cell comprising a landing site as described herein. In one preferred embodiment, the mammalian TI host cell is a CHO cell. In certain embodiments, the mammalian TI host cell is a Chinese hamster ovary (CHO) cell, a CHO K1 cell, a CHO K1SV cell, a CHO DG44 cell, a CHO DUKXB-11 cell, a CHO K1S cell, or a CHO K1M cell comprising a landing site as described herein integrated at a single site within a locus of the genome.

In certain embodiments, a mammalian TI host cell comprises an integrated landing site, wherein the landing site comprises one or more recombination recognition sequence (RRS). The RRS can be recognized by a recombinase, for example, a Cre recombinase, an FLP recombinase, a Bxb1 integrase, or a φC31 integrase. The RRS can be selected independently of each other from the group consisting of a LoxP sequence, a LoxP L3 sequence, a LoxP 2L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a φC31 attP sequence, and a PC31 attB sequence. If multiple RRSs have to be present, the selection of each of the sequences is dependent on the other insofar as non-identical RRSs are chosen.

In certain embodiments, the landing site comprises one or more recombination recognition sequence (RRS), wherein the RRS can be recognized by a recombinase. In certain embodiments, the integrated landing site comprises at least two RRSs. In certain embodiments, an integrated landing site comprises three RRSs, wherein the third RRS is located between the first and the second RRS. In certain preferred embodiments, all three RRSs are different. In certain embodiments, the landing site comprises a first, a second and a third RRS, and at least one selection marker located between the first and the second RRS, and the third RRS is different from the first and/or the second RRS. In certain embodiments, the landing site further comprises a second selection marker, and the first and the second selection markers are different. In certain embodiments, the landing site further comprises a third selection marker and an internal ribosome entry site (IRES), wherein the IRES is operably linked to the third selection marker. The third selection marker can be different from the first or the second selection marker.

Although the invention is exemplified with a CHO cell hereafter, this is presented solely to exemplify the invention but shall not be construed in any way as limitation. The true scope of the invention is set forth in the claims.

An exemplary mammalian TI host cell that is suitable for use in a method according to the current invention is a CHO cell harboring a landing site integrated at a single site within a locus of its genome wherein the landing site comprises three heterospecific IoxP sites for Cre recombinase mediated DNA recombination.

In this example, the heterospecific IoxP sites are L3, LoxFas and 2L (see e.g. Lanza et al., Biotechnol. J. 7 (2012) 898-908; Wong et al., Nucleic Acids Res. 33 (2005) e147), whereby L3 and 2L flank the landing site at the 5'-end and 3'-end, respectively, and LoxFas is located between the L3 and 2L sites. The landing site further contains a bicistronic unit linking the expression of a selection marker via an IRES to the expression of the fluorescent GFP protein allowing to stabilize the landing site by positive selection as well as to select for the absence of the site after transfection and Cre-recombination (negative selection). Green fluorescence protein (GFP) serves for monitoring the RMCE reaction.

Such a configuration of the landing site as outlined in the previous paragraph allows for the simultaneous integration of two vectors, e.g. of a so called front vector harboring an L3 and a LoxFas site and a back vector harboring a LoxFas and an 2L site. The functional elements of a selection marker gene different from that present in the landing site can be distributed between both vectors: promoter and start codon can be located on the front vector whereas coding region and poly A signal are located on the back vector. Only correct recombinase-mediated integration of said nucleic acids from both vectors induces resistance against the respective selection agent.

Generally, a mammalian TI host cell is a mammalian cell comprising a landing site integrated at a single site within a locus of the genome of the mammalian cell, wherein the landing site comprises a first and a second recombination recognition sequence flanking at least one first selection marker, and a third recombination recognition sequence located between the first and the second recombination recognition sequence, and all the recombination recognition sequences are different.

The selection marker(s) can be selected from the group consisting of an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid. The selection marker(s) can also be a fluorescent protein selected from the group consisting of green fluorescent protein (GFP), enhanced GFP (eGFP), a synthetic GFP, yellow fluorescent protein (YFP), enhanced YFP (eYFP), cyan fluorescent protein (CFP), mPlum, mCherry, tdTomato, mStrawberry, J-red, DsRed-monomer, mOrange, mKO, mCitrine, Venus, YPet, Emerald6, CyPet, mCFPm, Cerulean, and T-Sapphire.

An exogenous nucleotide sequence is a nucleotide sequence that does not originate from a specific cell but can be introduced into said cell by DNA delivery methods, such as, e.g., by transfection, electroporation, or transformation methods. In certain embodiments, a mammalian TI host cell comprises at least one landing site integrated at one or more integration sites in the mammalian cell's genome. In certain embodiments, the landing site is integrated at one or more integration sites within a specific a locus of the genome of the mammalian cell.

In certain embodiments, the integrated landing site comprises at least one selection marker. In certain embodiments, the integrated landing site comprises a first, a second and a third RRS, and at least one selection marker. In certain embodiments, a selection marker is located between the first and the second RRS. In certain embodiments, two RRSs flank at least one selection marker, i.e., a first RRS is located 5' (upstream) and a second RRS is located 3' (downstream) of the selection marker. In certain embodiments, a first RRS is adjacent to the 5'-end of the selection marker and a second RRS is adjacent to the 3'-end of the selection marker. In certain embodiments, the landing site comprises a first, second, and third RRS, and at least one selection marker located between the first and the third RRS.

In certain embodiments, a selection marker is located between a first and a second RRS and the two flanking RRSs are different. In certain preferred embodiments, the first flanking RRS is a LoxP L3 sequence and the second flanking RRS is a LoxP 2L sequence. In certain embodiments, a LoxP L3 sequence is located 5' of the selection marker and a LoxP 2L sequence is located 3' of the selection marker. In certain embodiments, the first flanking RRS is a wild-type FRT sequence and the second flanking RRS is a mutant FRT sequence. In certain embodiments, the first flanking RRS is a Bxb1 attP sequence and the second flanking RRS is a Bxb1 attB sequence. In certain embodiments, the first flanking RRS is a PC31 attP sequence and the second flanking RRS is a PC31 attB sequence. In certain embodiments, the two RRSs are positioned in the same orientation. In certain embodiments, the two RRSs are both in the forward or reverse orientation. In certain embodiments, the two RRSs are positioned in opposite orientation.

In certain embodiments, the integrated landing site comprises a first and a second selection marker, which are flanked by two RRSs, wherein the first selection marker is different from the second selection marker. In certain embodiments, the two selection markers are both independently of each other selected from the group consisting of a glutamine synthetase selection marker, a thymidine kinase selection marker, a HYG selection marker, and a puromycin resistance selection marker. In certain embodiments, the integrated landing site comprises a thymidine kinase selection marker and a HYG selection marker. In certain embodiments, the first selection maker is selected from the group consisting of an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid, and the second selection maker is selected from the group consisting of a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, and a T-Sapphire fluorescent protein. In certain embodiments, the first selection marker is a glutamine synthetase selection marker and the second selection marker is a GFP fluorescent protein. In certain embodiments, the two RRSs flanking both selection markers are different.

In certain embodiments, the selection marker is operably linked to a promoter sequence. In certain embodiments, the selection marker is operably linked to an SV40 promoter. In certain embodiments, the selection marker is operably linked to a human Cytomegalovirus (CMV) promoter.

Targeted Integration

One method for the generation of a recombinant mammalian cell according to the current invention is targeted integration (TI).

In targeted integration, site-specific recombination is employed for the introduction of an exogenous nucleic acid into a specific locus in the genome of a mammalian TI host cell. This is an enzymatic process wherein a sequence at the site of integration in the genome is exchanged for the exogenous nucleic acid. One system used to effect such nucleic acid exchanges is the Cre-lox system. The enzyme catalyzing the exchange is the Cre recombinase. The sequence to be exchanged is defined by the position of two lox (P)-sites in the genome as well as in the exogenous nucleic acid. These lox (P)-sites are recognized by the Cre recombinase. Nothing more is required, i.e. no ATP etc. Originally, the Cre-lox system has been found in bacteriophage P1.

The Cre-lox system operates in different cell types, like mammals, plants, bacteria and yeast.

In one embodiment, the exogenous nucleic acid encoding the heterologous polypeptide has been integrated into the mammalian TI host cell by single or double recombinase mediated cassette exchange (RMCE). Thereby a recombinant mammalian cell, such as a recombinant CHO cell, is obtained, in which a defined and specific expression cassette sequence has been integrated into the genome at a single locus, which in turn results in the efficient expression and production of the heterologous polypeptide.

The Cre-LoxP site-specific recombination system has been widely used in many biological experimental systems. Cre recombinase is a 38-kDa site-specific DNA recombinase that recognizes 34 bp LoxP sequences. Cre recombinase is derived from bacteriophage P1 and belongs to the tyrosine family site-specific recombinase. Cre recombinase can mediate both intra and intermolecular recombination between LoxP sequences. The LoxP sequence is composed of an 8 bp non-palindromic core region flanked by two 13 bp inverted repeats. Cre recombinase binds to the 13 bp repeat thereby mediating recombination within the 8 bp core region. Cre-LoxP-mediated recombination occurs at a high efficiency and does not require any other host factors. If two LoxP sequences are placed in the same orientation on the same nucleotide sequence, Cre recombinase-mediated recombination will excise DNA sequences located between the two LoxP sequences as a covalently closed circle. If two LoxP sequences are placed in an inverted position on the same nucleotide sequence, Cre recombinase-mediated recombination will invert the orientation of the DNA sequences located between the two sequences. If two LoxP sequences are on two different DNA molecules and if one DNA molecule is circular, Cre recombinase-mediated recombination will result in integration of the circular DNA sequence.

Matching RRSs

The term "matching RRSs" indicates that a recombination occurs between two RRSs. In certain embodiments, the two matching RRSs are the same. In certain embodiments, both RRSs are wild-type LoxP sequences. In certain embodiments, both RRSs are mutant LoxP sequences. In certain embodiments, both RRSs are wild-type FRT sequences. In certain embodiments, both RRSs are mutant FRT sequences. In certain embodiments, the two matching RRSs are different sequences but can be recognized by the same recombinase. In certain embodiments, the first matching RRS is a Bxb1 attP sequence and the second matching RRS is a Bxb1 attB sequence. In certain embodiments, the first matching RRS is a PC31 attB sequence and the second matching RRS is a PC31 attB sequence.

Two-Plasmid RMCE

A "two-plasmid RMCE" strategy or "double RMCE" is employed in the method according to the current invention when using a two-vector combination. For example, but not by way of limitation, an integrated landing site could comprise three RRSs, e.g., an arrangement where the third RRS ("RRS3") is present between the first RRS ("RRS1") and the second RRS ("RRS2"), while a first vector comprises two RRSs matching the first and the third RRS on the integrated exogenous nucleotide sequence, and a second vector comprises two RRSs matching the third and the second RRS on the integrated exogenous nucleotide sequence. The two-plasmid RMCE strategy involves using three RRS sites to carry out two independent RMCEs simultaneously. Therefore, a landing site in the mammalian TI host cell using the two-plasmid RMCE strategy includes a third RRS site (RRS3) that has no cross activity with either the first RRS site (RRS1) or the second RRS site (RRS2). The two plasmids to be targeted require the same flanking RRS sites for efficient targeting, one plasmid (front) flanked by RRS1 and RRS3 and the other (back) by RRS3 and RRS2. In addition, two selection markers are needed in the two-plasmid RMCE. One selection marker expression cassette was split into two parts. The front plasmid would contain the promoter followed by a start codon and the RRS3 sequence.

The back plasmid would have the RRS3 sequence fused to the N-terminus of the selection marker coding region, minus the start-codon (ATG). Additional nucleotides may need to be inserted between the RRS3 site and the selection marker sequence to ensure in frame translation for the fusion protein, i.e. operable linkage. Only when both plasmids are correctly inserted, the full expression cassette of the selection marker will be assembled and, thus, rendering cells resistance to the respective selection agent.

Two-plasmid RMCE involves double recombination cross-over events, catalyzed by a recombinase, between the two heterospecific RRSs within the target genomic locus and the donor DNA molecule. Two-plasmid RMCE is designed to introduce a copy of the DNA sequences from the front- and back-vector in combination into the pre-determined locus of a mammalian TI host cell's genome. RMCE can be implemented such that prokaryotic vector sequences are not introduced into the mammalian TI host cell's genome, thus, reducing and/or preventing unwanted triggering of host immune or defense mechanisms. The RMCE procedure can be repeated with multiple DNA sequences.

In certain embodiments, targeted integration is achieved by two RMCEs, wherein two different DNA sequences, each comprising at least one expression cassette encoding a part of a heteromultimeric polypeptide and/or at least one selection marker or part thereof flanked by two heterospecific RRSs, are both integrated into a pre-determined site of the genome of a RRSs matching mammalian TI host cell. In certain embodiments, targeted integration is achieved by multiple RMCEs, wherein DNA sequences from multiple vectors, each comprising at least one expression cassette encoding a part of a heteromultimeric polypeptide and/or at least one selection marker or part thereof flanked by two heterospecific RRSs, are all integrated into a predetermined site of the genome of a mammalian TI host cell. In certain embodiments the selection marker can be partially encoded on the first the vector and partially encoded on the second vector such that only the correct integration of both by double RMCE allows for the expression of the selection marker.

In certain embodiments, targeted integration via recombinase-mediated recombination leads to selection marker and/or the different expression cassettes for the multimeric polypeptide integrated into one or more pre-determined integration sites of a host cell genome free of sequences from a prokaryotic vector.

It has to be pointed out that, as in one embodiment, knockout can be performed either before introduction of the exogenous nucleic acid encoding the heterologous polypeptide or thereafter.

DETAILED DESCRIPTION OF THE INVENTION

XBP1 exon 4 comprises a 26 nucleotide fragment which is excised by IRE1α in vivo to introduce a +2 out of frame event and produce XBP1s. The present inventors have determined that skipping of exon 4 also introduces a +2 out of frame event and produces a functional protein. Skipping of exon 4 can be accomplished using antisense oligonucleotides of the invention. By skipping exon 4 in accordance with the invention, a much larger nucleotide fragment, of 146 bp, is removed from the pre-mRNA as compared to the 26 nucleotide fragment excised by IRE1a. Thus, XBP1Δ4 according to the invention is not equal to in vivo spliced XBP1.

The present inventors have also identified that the generation or expression of the XBP1Δ4 variant in mammalian cells results in an enhanced recombinant expression of heterologously expressed proteins, such as monoclonal antibodies, particularly of heterologously expressed proteins which are otherwise difficult to express. This indicates that the generation or expression of the XBP1Δ4 variant results in an enhanced quality of protein expression in mammalian cells.

The present invention discloses and utilizes specific antisense oligonucleotides, which are complementary, such as fully complementary, to a portion of the XBP1 pre-mRNA transcript. The antisense oligonucleotides of the invention are capable of reducing the inclusion (enhancing the excision) of XBP1 exon 4 in XBP1 transcripts. The antisense oligonucleotides of the invention thereby result in the expression of, or enhanced expression of, an XBP1Δ4 variant.

The inventors have identified that the generation or expression of the XBP1Δ4 variant in mammalian cells results in enhanced protein expression. The antisense oligonucleotides of the invention may therefore be used to enhance the yield or the quality of proteins produced from heterologous protein expression systems, for example in the manufacture of antibodies, such as monoclonal antibodies.

The antisense oligonucleotides of the invention also have therapeutic utilities in the treatment and prevention of proteopathological disease.

Antisense Oligonucleotides

In one aspect, the present invention relates to an antisense oligonucleotide for use in the expression of a XBP1 splice variant in a cell which expresses XBP1, wherein the antisense oligonucleotide is 8-40 nucleotides in length and comprises a contiguous nucleotide sequence of 8-40 nucleotides in length which is complementary to a mammalian XBP1 pre-mRNA transcript.

In certain embodiments of the present invention, the XBP1 splice variant has a +2 out of frame event.

In certain embodiments, the XBP1 splice variant is XBP1Δ4.

The invention provides an antisense oligonucleotide, wherein the antisense oligonucleotide is 8-40 nucleotides in length and comprises a contiguous nucleotide sequence of at least 12 nucleotides in length which is complementary, such as fully complementary, to a mammalian XBP1 pre-mRNA transcript.

The invention provides an antisense oligonucleotide, wherein the antisense oligonucleotide is 8-40 nucleotides in length and comprises a contiguous nucleotide sequence of 12-16 nucleotides in length which is complementary, such as fully complementary, to a mammalian XBP1 pre-mRNA transcript.

The invention provides an antisense oligonucleotide, wherein the antisense oligonucleotide is 12-16 nucleotides in length and comprises a contiguous nucleotide sequence of 12-16 nucleotides in length which is complementary, such as fully complementary, to a mammalian XBP1 pre-mRNA transcript.

The invention provides an antisense oligonucleotide, wherein the antisense oligonucleotide is 8-40 nucleotides in length and comprises a contiguous nucleotide sequence of 12-18 nucleotides in length which is complementary, such as fully complementary, to a mammalian XBP1 pre-mRNA transcript.

The antisense oligonucleotide may be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length.

In some embodiments, the antisense oligonucleotide is 8-40, 12-40, 12-20, 10-20, 14-18, 12-18 or 16-18 nucleotides in length.

The contiguous nucleotide sequence may be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. In some embodiments, the contiguous nucleotide sequence is at least 12 nucleotides in length, such as 12-16 or 12-18 nucleotides in length.

In some embodiments, the contiguous nucleotide sequence is the same length as the antisense oligonucleotide.

In some embodiments, the antisense oligonucleotide consists of the contiguous nucleotide sequence.

In some embodiments, the antisense oligonucleotide is the contiguous nucleotide sequence.

In some embodiments, the antisense oligonucleotide comprises a contiguous sequence of 8 to 40 nucleotides in length, which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more complementary with a region of the target nucleic acid or a target sequence. Put another way, in some embodiments, an antisense oligonucleotide of the invention may include one, two, three or more mis-matches, wherein a mis-match is a nucleotide within the antisense oligonucleotide of the invention which does not base pair with its target.

It is advantageous if the oligonucleotide, or contiguous nucleotide sequence thereof, is fully complementary (100% complementary) to a region of the target sequence.

In some embodiments, the antisense oligonucleotide is isolated, purified, or manufactured.

In some embodiments, the antisense oligonucleotide comprises one or more modified nucleotides or one or more modified nucleosides.

In some embodiments, the antisense oligonucleotide is a morpholino modified antisense oligonucleotide.

In some embodiments, the antisense oligonucleotide comprises one or more modified nucleosides, such as one or more modified nucleotides independently selected from the group consisting of 2'-O-alkyl-RNA; 2'-O-methyl RNA (2'-OMe); 2'-alkoxy-RNA; 2'-O-methoxyethyl-RNA (2'-MOE); 2'-amino-DNA; 2'-fluoro-RNA; 2'-fluoro-DNA; arabino nucleic acid (ANA); 2'-fluoro-ANA; bicyclic nucleoside analog (LNA); or any combination thereof.

In some embodiments, one or more of the modified nucleosides is a sugar modified nucleoside.

In some embodiments, one or more of the modified nucleosides comprises a bicyclic sugar.

In some embodiments, one or more of the modified nucleosides is an affinity enhancing 2' sugar modified nucleoside.

In some embodiments, one or more of the modified nucleosides is an LNA nucleoside.

In some embodiments, the antisense oligonucleotide, or contiguous nucleotide sequence thereof, comprises one or more 5'-methyl-cytosine nucleobases.

In some embodiments, one or more of the internucleoside linkages within the contiguous nucleotide sequence of the antisense oligonucleotide is modified.

In some embodiments, the one or more modified internucleoside linkages comprises a phosphorothioate linkage.

In some embodiments, at least about 75%, at least about 80%, at least about 85%, at least about 90%, at least about 95%, or about 100% of the internucleoside linkages of the antisense oligonucleotide or contiguous nucleotide sequence thereof are modified.

In some embodiments, at least about 75%, at least about 80%, at least about 85%, at least about 90%, at least about 95%, or about 100% of the internucleoside linkages of the antisense oligonucleotide or contiguous nucleotide sequence thereof are phosphorothioate internucleoside linkages.

In some embodiments, the antisense oligonucleotides of the invention are in solid powdered form, such as in the form of a lyophilized powder.

Additional disclosures regarding the above antisense oligonucleotides are provided throughout the present disclosure.

The target

As described herein, the antisense oligonucleotides of the invention target the XBP1 mRNA sequence in order to cause expression of an XBP1 splice variant, such as a XBP1Δ4 variant.

As used herein, the term "XBP1Δ4" refers to a XBP1 transcript which lacks exon 4 (a XBP1Δ4 variant), or a XBP1 protein which lacks the amino acids encoded by XBP1 exon 4. A key feature of the XBP1Δ4 variant is that the deletion of exon 4 and the introduction of a +2 frame shift in the XBP1 coding sequence has occurred, which results in the expression of a XBP1Δ4 variant with a C-terminal region which is homologous to the C-terminal region of the XBP1s variant of XBP1 (induced by IRE1).

In certain embodiments, a XBP1Δ4 protein lacks all or essentially all of the peptide sequence encoded by XBP1 exon 4.

The term "target", as used herein, is used to refer to the transcript of the gene that the antisense oligonucleotides of the present invention specifically hybridizes/binds to (i.e., "XBP1").

XBP1 is also known as X-box binding protein 1, TREB-5, TREB5, XBP-1, and XBP2.

The target for oligonucleotides of the present invention is an XBP1 pre-mRNA transcript. The XBP1 pre-mRNA transcript is preferably a mammalian XBP1 pre-mRNA transcript In some embodiments, the mammalian XBP1 pre-mRNA transcript is a hamster XBP1 pre-mRNA transcript.

The hamster XBP1 pre-mRNA sequence is recited in SEQ ID NO 1.

In certain embodiments, the contiguous nucleotide sequence is complementary to at least 10 contiguous nucleotides of the hamster XBP1 pre-mRNA transcript (SEQ ID NO 1).

In certain embodiments, the contiguous nucleotide sequence may be complementary to at least 10 contiguous nucleotides from nucleotides 2960-3113 of SEQ ID NO 1.

In other embodiments, the contiguous nucleotide sequence may be complementary to at least 10 contiguous nucleotides from nucleotides 2986-3018 of SEQ ID NO 1.

In some embodiments the contiguous nucleotide sequence is complementary to at least 10, at least 11, at least 12, at least 13, at least 14, at least 15, at least 16 or at least 17 contiguous nucleotides of the hamster XBP1 pre-mRNA transcript (SEQ ID NO 1).

In other embodiments the contiguous nucleotide sequence may be complementary to a nucleotide sequence selected from the group consisting of SEQ ID NO 299, SEQ ID NO.

301, SEQ ID NO 302, SEQ ID NO 304, SEQ ID NO 305, SEQ ID NO 306, SEQ ID NO 307, SEQ ID NO 308, SEQ ID NO 309, SEQ ID NO 310, SEQ ID NO 314, SEQ ID NO 316, SEQ ID NO 317, SEQ ID NO 318, SEQ ID NO 319, SEQ ID NO 323, SEQ ID NO 325, SEQ ID NO 327, SEQ ID NO 328, SEQ ID NO 330, SEQ ID NO 331, SEQ ID NO 332, SEQ ID NO 333, SEQ ID NO 334, SEQ ID NO 336, SEQ ID NO 337, SEQ ID NO 385, SEQ ID NO 386, SEQ ID NO 387, SEQ ID NO 388, SEQ ID NO 390, SEQ ID NO 391, SEQ ID NO 392, SEQ ID NO 393, SEQ ID NO 394, SEQ ID NO 395, SEQ ID NO 396 397, SEQ ID NO 398, SEQ ID NO 399, SEQ ID NO 401, SEQ ID NO 402, SEQ ID NO 419, SEQ ID NO 431, SEQ ID NO, SEQ ID NO 432, SEQ ID NO 433, SEQ ID NO 434, SEQ ID NO 438, SEQ ID NO 439, SEQ ID NO 440, SEQ ID NO 441, SEQ ID NO 442, SEQ ID NO 449, SEQ ID NO 484, SEQ ID NO 485, SEQ ID NO 486, SEQ ID NO 487, SEQ ID NO 488, SEQ ID NO 489, SEQ ID NO 490, SEQ ID NO 491, SEQ ID NO 492, SEQ ID NO 493, SEQ ID NO 494, SEQ ID NO 495, SEQ ID NO 496, SEQ ID NO 497, SEQ ID NO 498, SEQ ID NO 499, SEQ ID NO 500, SEQ ID NO 501, SEQ ID NO 502, SEQ ID NO 503, SEQ ID NO 505, SEQ ID NO 506, SEQ ID NO 507, SEQ ID NO 508, SEQ ID NO 509, SEQ ID NO 510, SEQ ID NO 511, SEQ ID NO 512, SEQ ID NO 513, SEQ ID NO 515, SEQ ID NO 517, SEQ ID NO 520, SEQ ID NO 572, SEQ ID NO 573, SEQ ID NO 576, SEQ ID NO 577, SEQ ID NO 588 and SEQ ID NO 589.

In other embodiments the contiguous nucleotide sequence may be complementary to a nucleotide sequence selected from the group consisting of SEQ ID NO 305, SEQ ID NO 307, SEQ ID NO 314, SEQ ID NO 315, SEQ ID NO 316, SEQ ID NO 317, SEQ ID NO 319, SEQ ID NO 331, SEQ ID NO 332, SEQ ID NO 392, SEQ ID NO 394, SEQ ID NO 395, SEQ ID NO 440, SEQ ID NO 492, SEQ ID NO 497, SEQ ID NO 498, SEQ ID NO 499, SEQ ID NO 500, SEQ ID NO 501, SEQ ID NO 502, SEQ ID NO 513 and SEQ ID NO 576.

In other embodiments the contiguous nucleotide sequence may be complementary to SEQ ID NO 314 or SEQ ID NO 315.

In some embodiments the mammalian XBP1 pre-mRNA transcript is a mouse XBP1 pre-mRNA transcript.

The mouse XBP1 pre-mRNA is recited in SEQ ID NO 590.

In certain embodiments the contiguous nucleotide sequence is complementary to at least 10 contiguous nucleotides of the mouse XBP1 pre-mRNA transcript (SEQ ID NO 590).

In certain embodiments the contiguous nucleotide sequence may be complementary to at least 10 contiguous nucleotides from nucleotides 3560-3783 of SEQ ID NO 590.

In some embodiments the contiguous nucleotide sequence is complementary to at least 10, at least 11, at least 12, at least 13, at least 14, at least 15, at least 16 or at least 17 contiguous nucleotides of the mouse XBP1 pre-mRNA transcript (SEQ ID NO 590).

In other embodiments the contiguous nucleotide sequence may be complementary to a nucleotide sequence selected from the group consisting of SEQ ID NO 699, SEQ ID NO 700, SEQ ID NO 703, SEQ ID NO 710, SEQ ID NO 713, SEQ ID NO 724, SEQ ID NO 729, SEQ ID NO 739, SEQ ID NO 743, SEQ ID NO 744, SEQ ID NO 745, SEQ ID NO 749, SEQ ID NO 750, SEQ ID NO 751, SEQ ID NO 752, SEQ ID NO 753, SEQ ID NO 754, SEQ ID NO 755, SEQ ID NO 756, SEQ ID NO 757, SEQ ID NO 758, SEQ ID NO 759, SEQ ID NO 760, SEQ ID NO 761, SEQ ID NO 762, SEQ ID NO 763, SEQ ID NO 773, SEQ ID NO 776, SEQ ID NO 778, SEQ ID NO 781, SEQ ID NO 783, SEQ ID NO 784, SEQ ID NO 785, SEQ ID NO 787, SEQ ID NO 789, SEQ ID NO 790, SEQ ID NO 791, SEQ ID NO 792, SEQ ID NO 793, SEQ ID NO 794, SEQ ID NO 795, SEQ ID NO 796, SEQ ID NO 797, SEQ ID NO 798, SEQ ID NO 799 and SEQ ID NO 800.

In other embodiments the contiguous nucleotide sequence may be complementary to a nucleotide sequence selected from the group consisting of SEQ ID NO 710, SEQ ID NO 754, SEQ ID NO 756, SEQ ID NO 757, SEQ ID NO 758, SEQ ID NO 759, SEQ ID NO 760, SEQ ID NO 791, SEQ ID NO 792, SEQ ID NO 794, SEQ ID NO 795 and SEQ ID NO 797.

In some embodiments, the mammalian XBP1 pre-mRNA transcript is a human XBP1 pre-mRNA transcript.

The human XBP1 pre-mRNA is recited in SEQ ID NO 801.

In certain embodiments the contiguous nucleotide sequence is complementary to at least 10 contiguous nucleotides of the human XBP1 pre-mRNA transcript (SEQ ID NO 801).

In certain embodiments, the contiguous nucleotide sequence may be complementary to at least 10 contiguous nucleotides from nucleotides 4338-4563 of SEQ ID NO 801

In some embodiments the contiguous nucleotide sequence is complementary to at least 10, at least 11, at least 12, at least 13, at least 14, at least 15, at least 16, or at least 17 contiguous nucleotides of the human XBP1 pre-mRNA transcript (SEQ ID NO 801).

In other embodiments, the contiguous nucleotide sequence may be complementary to a nucleotide sequence selected from the group consisting of SEQ ID NO 947, SEQ ID NO 948, SEQ ID NO 949, SEQ ID NO 950, SEQ ID NO 951 and SEQ ID NO 988.

In other embodiments, the contiguous nucleotide sequence may be complementary to SEQ ID NO 951.

Antisense Oligonucleotide Sequence

The contiguous nucleotide sequence may be complementary to a portion of the hamster XBP1 pre-mRNA transcript (SEQ ID NO 1).

In certain embodiments, the contiguous nucleotide sequence may be selected from the group consisting of SEQ ID NO 8, SEQ ID NO 10, SEQ ID NO 11, SEQ ID NO 13, SEQ ID NO 14, SEQ ID NO 15, SEQ ID NO 16, SEQ ID NO 17, SEQ ID NO 18, SEQ ID NO 19, SEQ ID NO 23, SEQ ID NO 24, SEQ ID NO 25, SEQ ID NO 26, SEQ ID NO 27, SEQ ID NO 28, SEQ ID NO 32, SEQ ID NO 34, SEQ ID NO 36, SEQ ID NO 37, SEQ ID NO 39, SEQ ID NO 40, SEQ ID NO 41, SEQ ID NO 42, SEQ ID NO 43, SEQ ID NO 45, SEQ ID NO 46, SEQ ID NO 94, SEQ ID NO 95, SEQ ID NO 96, SEQ ID NO 97, SEQ ID NO 99, SEQ ID NO 100, SEQ ID NO 101, SEQ ID NO 102, SEQ ID NO 103, SEQ ID NO 104, SEQ ID NO 105, SEQ ID NO 106, SEQ ID NO 107, SEQ ID NO 108, SEQ ID NO 110, SEQ ID NO 111, SEQ ID NO 128, SEQ ID NO 140, SEQ ID NO 141, SEQ ID NO 142, SEQ ID NO 143, SEQ ID NO 147, SEQ ID NO 148, SEQ ID NO 149, SEQ ID NO 150, SEQ ID NO 151, SEQ ID NO 158, SEQ ID NO 193, SEQ ID NO 194, SEQ ID NO 195, SEQ ID NO 196, SEQ ID NO 197, SEQ ID NO 198, SEQ ID NO 199, SEQ ID NO 200, SEQ ID NO 201, SEQ ID NO 202, SEQ ID NO 203, SEQ ID NO 204, SEQ ID NO 205, SEQ ID NO 206, SEQ ID NO 207, SEQ ID NO 208, SEQ ID NO 209, SEQ ID NO 210, SEQ ID NO 211, SEQ ID NO 212, SEQ ID NO 214, SEQ ID NO 215, SEQ ID NO 216, SEQ ID NO 217, SEQ ID NO 218, SEQ ID NO 219, SEQ ID NO 220, SEQ ID NO 221, SEQ ID NO 222, SEQ ID NO 224, SEQ ID NO 226, SEQ ID NO 229, SEQ ID NO 281, SEQ ID NO 282, SEQ ID NO 285, SEQ ID NO 286, SEQ ID NO 297 and SEQ ID NO 298.

In certain embodiments, the contiguous nucleotide sequence may be selected from the group consisting of SEQ ID NO 14, SEQ ID NO 16, SEQ ID NO 23, SEQ ID NO 24, SEQ ID NO 25, SEQ ID NO 26, SEQ ID NO 28, SEQ ID NO 40, SEQ ID NO 41, SEQ ID NO 101, SEQ ID NO 103, SEQ ID NO 104, SEQ ID NO 149, SEQ ID NO 201, SEQ ID NO 206, SEQ ID NO 207, SEQ ID NO 208, SEQ ID NO 209, SEQ ID NO 210, SEQ ID NO 211, SEQ ID NO 222 and SEQ ID NO 285.

In certain embodiments, the contiguous nucleotide sequence may be SEQ ID NO 23 or SEQ ID NO 24.

The contiguous nucleotide sequence may be complementary to a portion of the mouse XBP1 pre-mRNA transcript (SEQ ID NO 590).

In certain embodiments, the contiguous nucleotide sequence may be selected from the group consisting of SEQ ID NO 597, SEQ ID NO 598, SEQ ID NO 601, SEQ ID NO 608, SEQ ID NO 611, SEQ ID NO 622, SEQ ID NO 627, SEQ ID NO 637, SEQ ID NO 641, SEQ ID NO 642, SEQ ID NO 643, SEQ ID NO 647, SEQ ID NO 648, SEQ ID NO 649, SEQ ID NO 650, SEQ ID NO 651, SEQ ID NO 652, SEQ ID NO 653, SEQ ID NO 654, SEQ ID NO 655, SEQ ID NO 656, SEQ ID NO 657, SEQ ID NO 658, SEQ ID NO 659, SEQ ID NO 660, SEQ ID NO 661, SEQ ID NO 671, SEQ ID NO 674, SEQ ID NO 676, SEQ ID NO 679, SEQ ID NO 681, SEQ ID NO 682, SEQ ID NO 683, SEQ ID NO 685, SEQ ID NO 687, SEQ ID NO 688, SEQ ID NO 689, SEQ ID NO 690, SEQ ID NO 691, SEQ ID NO 692, SEQ ID NO 693, SEQ ID NO 694, SEQ ID NO 695, SEQ ID NO 696, SEQ ID NO 697 and SEQ ID NO 698.

In certain embodiments, the contiguous nucleotide sequence may be selected from the group consisting of SEQ ID NO 608, SEQ ID NO 652, SEQ ID NO 654, SEQ ID NO 655, SEQ ID NO 656, SEQ ID NO 657, SEQ ID NO 658, SEQ ID NO 689, SEQ ID NO 690, SEQ ID NO 692, SEQ ID NO 693 and SEQ ID NO 695.

The contiguous nucleotide sequence may be complementary to a portion of the human XBP1 pre-mRNA transcript (SEQ ID NO 801).

In certain embodiments, the contiguous nucleotide sequence may be selected from the group consisting of SEQ ID NO 854, SEQ ID NO 855, SEQ ID NO 856, SEQ ID NO 857, SEQ ID NO 858 and SEQ ID NO 895.

In certain embodiments, the contiguous nucleotide sequence may be SEQ ID NO 858.

In some embodiments, the contiguous nucleotide sequence is the same length as the antisense oligonucleotide.

In some embodiments, the antisense oligonucleotide consists of the contiguous nucleotide sequence.

In some embodiments, the antisense oligonucleotide is the contiguous nucleotide sequence.

The invention also contemplates fragments of the contiguous nucleotide sequence, including fragments of at least 8, at least 9, at least 10, at least 11, at least 12, at least 13, at least 14, at least 15, at least 16 or at least 17 contiguous nucleotides thereof.

Antisense Oligonucleotide Activity

In some embodiments, the antisense oligonucleotides of the present invention modulate the splicing of a mammalian XBP1 pre-mRNA transcript, such as that described herein. In some embodiments, modulating the splicing of a mammalian XBP1 pre-mRNA transcript can regulate the expression and/or activity of certain XBP1 variants.

Without wishing to be bound by theory, splice modulating oligonucleotides typically operate via an occupation-based mechanism rather than via a degradation mechanism (such as RNaseH or RISC mediated inhibition).

In some embodiments, the antisense oligonucleotides of the invention are capable of reducing or inhibiting the expression (e.g., number) of a XBP1 mRNA transcript comprising exon 4 in a cell. Herein a XBP1 mRNA transcript comprising exon 4 is referred to as XBP1-E4.

The term "reducing" or "inhibiting" the expression of a transcript as used herein is to be understood as an overall term for an antisense oligonucleotide's ability to inhibit or reduce the amount or the activity of XBP1-E4 protein in a target cell (e.g., by reducing or inhibiting the expression of XBP1-E4 mRNA and thereby reducing the expression of a XBP1-E4 protein).

Inhibition of activity can be determined by measuring the level (e.g., number) of XBP1-E4 mRNA, or by measuring the level (e.g., number) or activity of XBP1-E4 protein in a cell. Inhibition of expression can therefore be determined in vitro or in vivo. It will be understood that splice modulation can result in an inhibition of expression (e.g., number) of XBP1-E4 transcript (e.g., mRNA), or the protein encoded thereof, in the cell. In certain embodiments, the expression (e.g., number) of XBP1-E4 transcript (e.g., mRNA) is reduced by at least about 1%, at least about 2%, at least about 3%, at least about 5%, at least about 10%, at least about 20%, at least about 30%, at least about 40%, at least about 50% or more compared to a corresponding cell that is not exposed to the antisense oligonucleotide.

As used herein, the term "corresponding cell that is not exposed to the antisense oligonucleotide" can refer to the same cell prior to the treatment with an antisense oligonucleotide of the invention, or to the same cell type (but not the same cell).

Accordingly, in some embodiments treating a cell with an antisense oligonucleotide of the present invention reduces (e.g., by at least about 10% or by at least about 20%) the expression of XBP1-E4 transcript (e.g., mRNA) in the cell compared to the expression of XBP1-E4 transcript (e.g., mRNA) in the same cell prior to the antisense oligonucleotide treatment.

In other embodiments treating a cell with an antisense oligonucleotide of the present invention reduces (e.g., by at least about 10% or by at least about 20%) the expression of XBP1-E4 transcript (e.g., mRNA) in the cell compared to the expression of XBP1-E4 transcript (e.g., mRNA) in the same cell type which has not undergone antisense oligonucleotide treatment.

In some embodiments, the antisense oligonucleotides of the invention are capable of increasing or enhancing the expression (e.g., number) of a XBP1 mRNA transcript lacking exon 4 in a cell. Herein a XBP1 mRNA transcript lacking exon 4 is referred to as XBP1Δ4.

The term "increasing" the expression of a transcript as used herein is to be understood as an overall term for an antisense oligonucleotide's ability to increase or enhance the amount or the activity of XBP1Δ4 protein in a target cell (e.g., by increasing the expression of XBP1Δ4 mRNA and thereby increasing the expression of a XBP1Δ4 protein).

Increases in activity can be determined by measuring the level (e.g., number) of XBP1Δ4 mRNA, or by measuring the level (e.g., number) or activity of XBP1Δ4 protein in a cell. Increases in expression can therefore be determined in vitro or in vivo. It will be understood that splice modulation can result in an increase in expression (e.g., number) of XBP1Δ4 transcript (e.g., mRNA), or the protein encoded thereof, in the cell. In certain embodiments, the expression (e.g., number) of XBP1Δ4 transcript (e.g., mRNA) is increased or enhanced by at least about 1%, at least about 2%, at least about 3%, at least about 5%, at least about 10%, at least about 20%, at least about 30%, at least about 40%, at least about 50% or more compared to a corresponding cell that is not exposed to the antisense oligonucleotide. It is preferred that the expression (e.g., number) of XBP1Δ4 transcript (e.g., mRNA) is increased or enhanced by at least about 1% or at least about 5% compared to a corresponding cell that is not exposed to the antisense oligonucleotide.

As used herein, the term "corresponding cell that is not exposed to the antisense oligonucleotide" can refer to the same cell prior to the treatment with an antisense oligonucleotide of the invention, or to the same cell type (but not the same cell).

Accordingly, in some embodiments treating a cell with an antisense oligonucleotide of the present invention increases or enhances (e.g., by at least about 10% or by at least about 20%) the expression of XBP1Δ4 transcript (e.g., mRNA) in the cell compared to the expression of XBP1Δ4 transcript (e.g., mRNA) in the same cell prior to the antisense oligonucleotide treatment.

In other embodiments treating a cell with an antisense oligonucleotide of the present invention increases or enhances (e.g., by at least about 10% or by at least about 20%) the expression of XBP1Δ4 transcript (e.g., mRNA) in the cell compared to the expression of XBP1Δ4 transcript (e.g., mRNA) in the same cell type which has not undergone antisense oligonucleotide treatment.

In some embodiments, the antisense oligonucleotides of the invention can change the ratio of alternative XBP1 splice variants expressed in a cell. For instance, increased or enhanced expression of XBP1Δ4 will result in an increase in the ratio of expression of XBP1Δ4/XBP1E4 transcripts.

Accordingly, in some embodiments, the antisense oligonucleotides disclosed herein can increase the ratio of expression of XBP1Δ4/XBP1E4 mRNA transcripts compared to a corresponding ratio of a cell that is not exposed to the antisense oligonucleotides of the present invention. In certain embodiments, the ratio of the expression of XBP1Δ4 mRNA transcript to the expression of XBP1-E4 mRNA transcript is increased by at least about 2-fold, at least about 3-fold, at least about 4-fold, at least about 5-fold, at least about 10-fold, at least about 20-fold, at least about 25-fold, at least about 30-fold, at least about 35-fold, at least about 40-fold, at least about 50-fold or more compared to a corresponding ratio of a cell that is not exposed to the antisense oligonucleotides of the present invention In some embodiments, the antisense oligonucleotides disclosed herein can increase the ratio of expression of XBP1Δ4/XBP1E4 protein compared to a corresponding ratio of a cell that is not exposed to the antisense oligonucleotides of the present invention. In certain embodiments, the ratio of the expression of XBP1Δ4 protein to the expression of XBP1-E4 protein is increased by at least about 2-fold, at least about 3-fold, at least about 4-fold, at least about 5-fold, at least about 10-fold, at least about 20-fold, at least about 25-fold or more compared to a corresponding ratio of a cell that is not exposed to the antisense oligonucleotides of the present invention In some embodiments, the antisense oligonucleotides of the invention are capable of both i) increasing the amount of XBP1Δ4 mRNA or XBP1Δ4 protein in the target cell and ii) decreasing the amount of XBP1-E4 mRNA and XBP1-E4 protein in a target cell.

The change in ratio of different transcript products (e.g., XBP1-E4 vs. XBP1Δ4) can be measured by comparing mRNA levels, or levels of the corresponding protein products. Anti-XBP1 antibodies which can be used for assaying the protein levels of XBP1-E4 and XBP1Δ4 including monoclonal or polyclonal antibodies raised against XBP1.

Oligonucleotide Design

The antisense oligonucleotides of the invention can comprise a nucleotide sequence which comprises both nucleosides and nucleoside analogs, and can be in the form of a gapmer, blockmer, mixmer, headmer, tailmer, or totalmer.

In one embodiment, the antisense oligonucleotide comprises at least 1 modified nucleoside, such as at least 2, at least 3, at least 4, at least 5, at least 6, at least 7, at least 8, at least 9, at least 10, at least 11, at least 12, at least 13, at least 14, at least 16, at least 16 or at least 17 modified nucleosides.

The term "gapmer" as used herein refers to an antisense oligonucleotide which comprises a region of RNase H recruiting oligonucleotides (gap) which is flanked 5' and 3' by one or more affinity enhancing modified nucleosides (flanks). The terms "headmers" and "tailmers" are oligonucleotides capable of recruiting RNase H where one of the flanks is missing, i.e., only one of the ends of the oligonucleotide comprises affinity enhancing modified nucleosides. For headmers, the 3' flank is missing (i.e., the 5' flank comprise affinity enhancing modified nucleosides) and for tailmers, the 5' flank is missing (i.e., the 3' flank comprises affinity enhancing modified nucleosides). The term "LNA gapmer" is a gapmer oligonucleotide wherein at least one of the affinity enhancing modified nucleosides is an LNA nucleoside. The term "mixed wing gapmer" refers to an LNA gapmer wherein the flank regions comprise at least one LNA nucleoside and at least one DNA nucleoside or non-LNA modified nucleoside, such as at least one 2' substituted modified nucleoside, such as, for example, 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, 2'-Fluro-DNA, arabino nucleic acid (ANA), and 2'-Fluoro-ANA nucleoside(s).

Other "chimeric" antisense oligonucleotides, called "mixmers", consist of an alternating composition of (i) DNA monomers or nucleoside analog monomers recognizable and cleavable by RNase, and (ii) non-RNase recruiting nucleoside analog monomers.

A "totalmer" is a single stranded ASO which only comprises non-naturally occurring nucleotides or nucleotide analogs.

High Affinity Modified Nucleosides

A high affinity modified nucleoside is a modified nucleotide which, when incorporated into the oligonucleotide enhances the affinity of the oligonucleotide for its complementary target, for example as measured by the melting temperature (Tm). A high affinity modified nucleoside of the present invention preferably results in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3 (2), 203-213).

Sugar Modifications

The antisense oligonucleotides of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'—OH group naturally found in DNA and RNA nucleosides. Substituents may, for example be introduced at the 2', 3', 4' or 5' positions.

2' Sugar Modified Nucleosides

A 2' sugar modified nucleoside is a nucleoside which has a substituent other than H or—OH at the 2' position (2' substituted nucleoside) or comprises a 2' linked biradicle capable of forming a bridge between the 2' carbon and a second carbon in the ribose ring, such as LNA (2'-4' biradicle bridged) nucleosides.

Indeed, much focus has been given to developing 2' sugar substituted nucleosides, and numerous 2' substituted nucleosides have been found to have beneficial properties when incorporated into oligonucleotides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3 (2), 203-213, and Deleavey and Damha, Chemistry and Biology 2012, 19, 937. Below in Scheme 1 are illustrations of some 2' substituted modified nucleosides.

Scheme 1

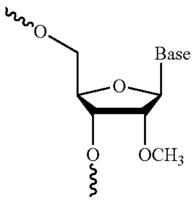
2'-O-Me

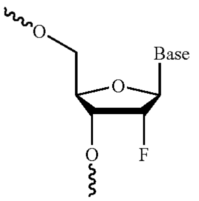
2'F-RNA

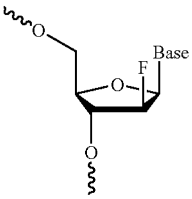
2'F-ANA

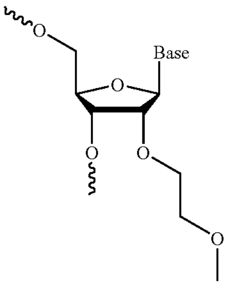
2'-O-MOE

-continued

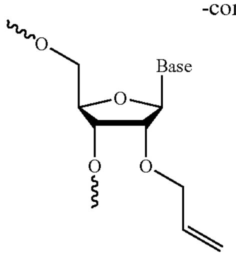
2'-O-Allyl

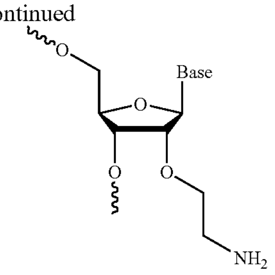
2'-O-Ethylamine

In relation to the present invention 2' substituted sugar modified nucleosides does not include 2' bridged nucleosides like LNA.

Locked Nucleic Acid Nucleosides (LNA Nucleoside)

A “LNA nucleoside” is a 2'-modified nucleoside which comprises a biradical linking the C2' and C4' of the ribose sugar ring of said nucleoside (also referred to as a “2'-4' bridge”), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., Bioorganic & Med. Chem. Lett. 12, 73-76, Seth et al. J. Org. Chem. 2010, Vol 75 (5) pp. 1569-81, and Mitsuoka et al., Nucleic Acids Research 2009, 37 (4), 1225-1238, and Wan and Seth, J. Medical Chemistry 2016, 59, 9645-9667.

Further non limiting, exemplary LNA nucleosides are disclosed in Scheme 2.

Scheme 2

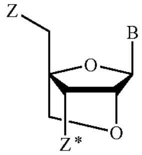
β-D-oxy LNA

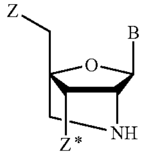
β-D-amino LNA

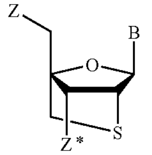
β-D-thio LNA

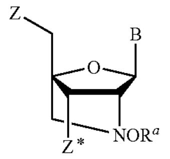
β-D-amino substituted LNA

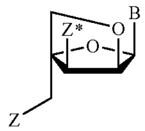
α-L-oxy LNA

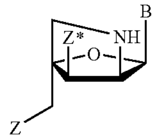
α-L-amino LNA

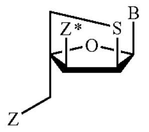
α-L-thio LNA

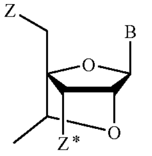
6'-methyl-β-D-oxy LNA

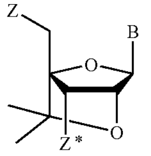
6'-dimethyl-β-D-oxy LNA

-continued

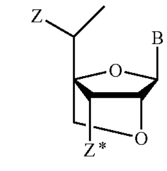

5′-methyl-β-D-oxy LNA

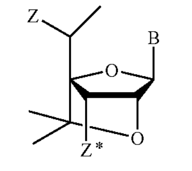

5′-methyl-6′-dimethyl-β-D-oxy LNA

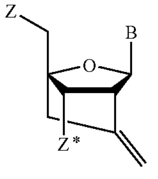

carbocyclic(vinyl)-β-D-oxy LNA

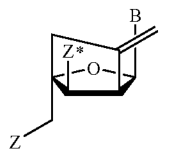

carboxyclic(vinyl)-α-L-oxy LNA

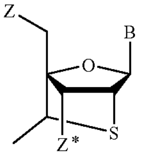

6′-methyl-β-D-thio LNA

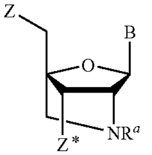

β-D-amino substituted LNA

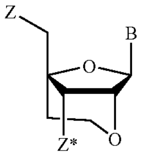

ENA

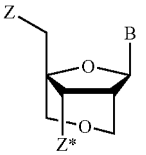

COC

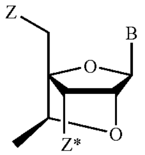

(S)-cET

Particular LNA nucleosides are beta-D-oxy-LNA, 6'-methyl-beta-D-oxy LNA such as(S)-6'-methyl-beta-D-oxy-LNA (ScET) and ENA.

A particularly advantageous LNA is beta-D-oxy-LNA.

Morpholino Oligonucleotides

In some embodiments, the antisense oligonucleotide of the invention comprises or consists of morpholino nucleosides (i.e. is a Morpholino oligomer and as a phosphorodiamidate Morpholino oligomer (PMO)). Splice modulating morpholino oligonucleotides have been approved for clinical use-see for example eteplirsen, a 30nt morpholino oligonucleotide targeting a frame shift mutation in DMD, used to treat Duchenne muscular dystrophy. Morpholino oligonucleotides have nucleobases attached to six membered morpholine rings rather ribose, such as methylenemorpholine rings linked through phosphorodiamidate groups, for example as illustrated by the following illustration of 4 consecutive morpholino nucleotides (Scheme 3):

Scheme 3

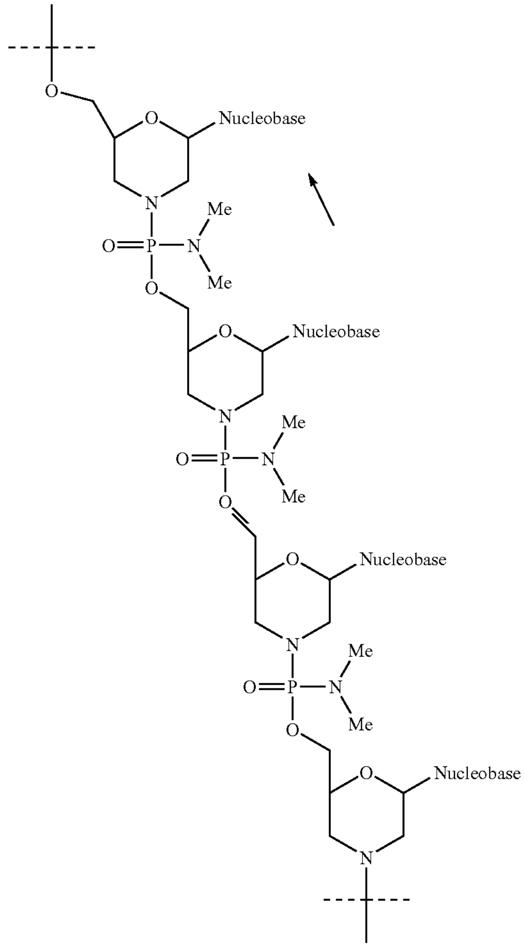

In some embodiments, morpholino oligonucleotides of the invention may be, for example 20-40 morpholino nucleotides in length, such as morpholino 25-35 nucleotides in length.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 5%, such as at least 10%, at least 20% or more than 20%, of the initial rate determined when using an oligonucleotide having the same base sequence as the modified oligonucleotide being tested, but containing only DNA monomers with phosphorothioate linkages between all monomers in the oligonucleotide, and using the methodology provided by Examples 91-95 of WO01/23613 (hereby incorporated by reference). For use in determining RHase H activity, recombinant RNase H1 is available from Lubio Science GmbH, Lucerne, Switzerland.

DNA oligonucleotides are known to effectively recruit RNaseH, as are gapmer oligonucleotides which comprise a region of DNA nucleosides (typically at least 5 or 6 contiguous DNA nucleosides), flanked 5' and 3' by regions comprising 2' sugar modified nucleosides, typically high affinity 2' sugar modified nucleosides, such as 2-O-MOE and/or LNA. For effective modulation of splicing, degradation of the pre-mRNA is not desirable, and as such it is preferable to avoid the RNaseH degradation of the target. Therefore, the antisense oligonucleotides of the invention are not RNaseH recruiting gapmer oligonucleotide.

RNaseH recruitment may be avoided by limiting the number of contiguous DNA nucleotides in the oligonucleotide-therefore mixmers and totalmer designs may be used.

Advantageously the antisense oligonucleotides of the invention, or the contiguous nucleotide sequence thereof, do not comprise more than 3 contiguous DNA nucleosides. Further, advantageously the antisense oligonucleotides of the invention, or the contiguous nucleotide sequence thereof, do not comprise more than 4 contiguous DNA nucleosides. Further advantageously, the antisense oligonucleotides of the invention, or contiguous nucleotide sequence thereof, do not comprise more than 2 contiguous DNA nucleosides.

Mixmers and Totalmers

For splice modulation it is often advantageous to use antisense oligonucleotides which do not recruit RNAaseH. As RNaseH activity requires a contiguous sequence of DNA nucleotides, RNaseH activity of antisense oligonucleotides may be achieved by designing antisense oligonucleotides which do not comprise a region of more than 3 or more than 4 contiguous DNA nucleosides. This may be achieved by using antisense oligonucleotides or contiguous nucleoside regions thereof with a mixmer design, which comprise sugar modified nucleosides, such as 2' sugar modified nucleosides, and short regions of DNA nucleosides, such as 1, 2 or 3 DNA nucleosides. Mixmers are exemplified herein by every second design, wherein the nucleosides alternate between 1 LNA and 1 DNA nucleoside, e.g. LDLDLDLDLDLDLDLL, with 5' and 3' terminal LNA nucleosides, and every third design, such as LDDLDDLDDLDDLDDL, where every third nucleoside is a LNA nucleoside.

A totalmer is an antisense oligonucleotide or a contiguous nucleotide sequence thereof which does not comprise DNA or RNA nucleosides, and may for example comprise only 2'-O-MOE nucleosides, such as a fully MOE phosphorothioate, e.g. MMMMMMMMMMMMMMMMMMMM, where M=2'-O-MOE, which are reported to be effective splice modulators for therapeutic use.

Alternatively, a mixmer may comprise a mixture of modified nucleosides, such as MLMLMLMLMLMLMLMLMLML, wherein L=LNA and M=2'-O-MOE nucleosides.

Advantageously, the internucleoside nucleosides in mixmers and totalmers may be phosphorothioate, or a majority of nucleoside linkages in mixmers may be phosphorothioate. Mixmers and totalmers may comprise other internucleoside linkages, such as phosphodiester or phosphorodithioate, by way of example.

Region D' or D" in an Oligonucleotide

The antisense oligonucleotide of the invention may in some embodiments comprise or consist of the contiguous nucleotide sequence of the oligonucleotide which is complementary to the target nucleic acid, such as a mixmer or totalmer region, and further 5' and/or 3' nucleosides. The further 5' and/or 3' nucleosides may or may not be complementary, such as fully complementary, to the target nucleic acid. Such further 5' and/or 3' nucleosides may be referred to as region D' and D" herein.

The addition of region D' or D" may be used for the purpose of joining the contiguous nucleotide sequence, such as the mixmer or totalmer, to a conjugate moiety or another functional group. When used for joining the contiguous nucleotide sequence with a conjugate moiety it can serve as a biocleavable linker. Alternatively, it may be used to provide exonucleoase protection or for ease of synthesis or manufacture.

Region D' or D" may independently comprise or consist of 1, 2, 3, 4 or 5 additional nucleotides, which may be complementary or non-complementary to the target nucleic acid. The nucleotide adjacent to the F or F' region is not a sugar-modified nucleotide, such as a DNA or RNA or base modified versions of these. The D' or D" region may serve as a nuclease susceptible biocleavable linker (see definition of linkers). In some embodiments the additional 5' and/or 3' end nucleotides are linked with phosphodiester linkages, and are DNA or RNA. Nucleotide based biocleavable linkers suitable for use as region D' or D" are disclosed in WO2014/076195, which include by way of example a phosphodiester linked DNA dinucleotide. The use of biocleavable linkers in poly-oligonucleotide constructs is disclosed in WO2015/113922, where they are used to link multiple antisense constructs within a single oligonucleotide.

In one embodiment the antisense oligonucleotide of the invention comprises a region D' and/or D" in addition to the contiguous nucleotide sequence which constitutes a mixmer or a totalmer.

In some embodiments the internucleoside linkage positioned between region D' or D" and the mixmer or totalmer region is a phosphodiester linkage.

Conjugates

The invention encompasses an antisense oligonucleotide covalently attached to at least one conjugate moiety. In some embodiments this may be referred to as a conjugate of the invention.

The term "conjugate" as used herein refers to an antisense oligonucleotide which is covalently linked to a non-nucleotide moiety (conjugate moiety or region C or third region). The conjugate moiety may be covalently linked to the antisense oligonucleotide, optionally via a linker group, such as region D' or D".

Oligonucleotide conjugates and their synthesis has also been reported in comprehensive reviews by Manoharan in Antisense Drug Technology, Principles, Strategies, and Applications, S.T. Crooke, ed., Ch. 16, Marcel Dekker, Inc., 2001 and Manoharan, Antisense and Nucleic Acid Drug Development, 2002, 12, 103.

In some embodiments, the conjugate moiety may comprise a protein, a fatty acid chain, a sugar residue, a glycoprotein, a polymer or any combination thereof.

In some embodiments, the non-nucleotide moiety (conjugate moiety) is selected from the group consisting of carbohydrates (e.g. GalNAc), cell surface receptor ligands, drug substances, hormones, lipophilic substances, polymers, proteins, peptides, toxins (e.g. bacterial toxins), vitamins, viral proteins (e.g. capsids) or combinations thereof.

In some embodiments, the antisense oligonucleotide conjugate of the invention is a prodrug. Here the conjugate moiety may be cleaved off the nucleic acid molecule once the prodrug is delivered to the site of action, e.g. the target cell.

Linkers

A linkage or linker is a connection between two atoms that links one chemical group or segment of interest to another chemical group or segment of interest via one or more covalent bonds. Conjugate moieties can be attached to the antisense oligonucleotide directly or through a linking moiety (e.g. linker or tether). Linkers serve to covalently connect a third region, e.g. a conjugate moiety (Region C), to a first region, e.g. an oligonucleotide or contiguous nucleotide sequence complementary to the target nucleic acid (region A).

In some embodiments of the invention the conjugate or antisense oligonucleotide conjugate of the invention may optionally comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In some embodiments the nuclease susceptible linker comprises between 1 and 5 nucleosides, such as DNA nucleoside(s) comprising at least two consecutive phosphodiester linkages. Phosphodiester containing biocleavable linkers are described in more detail in WO 2014/076195.

Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups. The antisense oligonucleotide conjugates of the present invention can be constructed of the following regional elements A-C, A-B-C, A-B—Y—C, A-Y—B—C or A-Y-C. In some embodiments the linker (region Y) is an amino alkyl, such as a C2-C36 amino alkyl group, including, for example C6 to C12 amino alkyl groups. In some embodiments the linker (region Y) is a C6 amino alkyl group.

Pharmaceutical Salt

The invention provides for an antisense oligonucleotide according to the invention wherein the antisense oligonucleotide is in the form of a pharmaceutically acceptable salt. The term "pharmaceutically acceptable salt" refers to conventional acid-addition salts or base-addition salts that retain the biological effectiveness and properties of the antisense oligonucleotides of the present invention.

In some embodiments, the pharmaceutically acceptable salt may be a sodium salt, a potassium salt or an ammonium salt.

The invention provides for a pharmaceutically acceptable sodium salt of the antisense oligonucleotide according to the invention, or the conjugate according to the invention.

The invention provides for a pharmaceutically acceptable potassium salt of the antisense oligonucleotide according to the invention, or the conjugate according to the invention.

The invention provides for a pharmaceutically acceptable ammonium salt of the antisense oligonucleotide according to the invention, or the conjugate according to the invention.

Pharmaceutical Composition

The invention provides for a pharmaceutical composition comprising the antisense oligonucleotide of the invention, or the conjugate of the invention, or the salt of the invention, and a pharmaceutically acceptable diluent, solvent, carrier, salt and/or adjuvant.

A pharmaceutically acceptable diluent includes phosphate-buffered saline (PBS) and pharmaceutically acceptable salts include, but are not limited to, sodium and potassium salts. In some embodiments the pharmaceutically acceptable diluent is sterile phosphate buffered saline. In some embodiments, the nucleic acid molecule is used in the pharmaceutically acceptable diluent at a concentration of 50 to 300 UM solution.

Suitable formulations for use in the present invention are found in Remington's Pharmaceutical Sciences, Mack Publishing Company, Philadelphia, Pa., 17th ed., 1985. For a brief review of methods for drug delivery, see, e.g., Langer (Science 249:1527-1533, 1990). WO 2007/031091 provides further suitable and preferred examples of pharmaceutically acceptable diluents, carriers and adjuvants (hereby incorporated by reference). Suitable dosages, formulations, administration routes, compositions, dosage forms, combinations with other therapeutic agents, pro-drug formulations are also provided in WO2007/031091.

The invention provides for a pharmaceutical composition comprising the antisense oligonucleotide of the invention, or the conjugate of the invention, and a pharmaceutically acceptable salt. For example, the salt may comprise a metal cation, such as a sodium salt, a potassium salt or an ammonium salt.

The invention provides for a pharmaceutical composition according to the invention, wherein the pharmaceutical composition comprises the antisense oligonucleotide of the invention or the conjugate of the invention, or the pharmaceutically acceptable salt of the invention; and an aqueous diluent or solvent.

In some embodiments, the antisense oligonucleotide of the invention, the conjugate of the invention, or pharmaceutically acceptable salt thereof is in a solid form, such as a powder, such as a lyophilized powder.

The antisense oligonucleotide of the invention, conjugate of the invention or salt of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

These compositions may be sterilized by conventional sterilization techniques, or may be sterile filtered. The resulting aqueous solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the above-mentioned agent or agents, such as in a sealed package of tablets or capsules. The composition in solid form can also be packaged in a container for a flexible quantity, such as in a squeezable tube designed for a topically applicable cream or ointment.

Composition

In one aspect the present invention provides a composition comprising an antisense oligonucleotide according to the invention or the conjugate according to the invention, or the salt according to the invention; and a diluent, solvent, carrier, salt and/or adjuvant.

The composition may be a pharmaceutical composition.

Method of Manufacture of the Oligonucleotide According to the Invention

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313).

In a further embodiment, the method further comprises reacting the contiguous nucleotide sequence with a conjugating moiety (ligand) to covalently attach a conjugate moiety to the oligonucleotide.

In a further embodiment, a method is provided for manufacturing the composition of the invention, comprising mixing the oligonucleotide or conjugated oligonucleotide of the invention with a pharmaceutically acceptable diluent, solvent, carrier, salt and/or adjuvant.

XBP1Δ4 Protein

In one aspect, the invention includes an isolated XBP1Δ4 protein.

The isolated XBP1Δ4 protein may be a mammalian protein. In some embodiments the XBP1Δ4 protein may be a hamster, mouse or human protein.

In certain embodiments, the isolated XBP1Δ4 protein is a hamster protein and is encoded by SEQ ID NO 7.

In certain embodiments, the isolated XBP1Δ4 protein is a mouse protein and is encoded by SEQ ID NO 596.

In certain embodiments, the isolated XBP1Δ4 protein is a human protein and is encoded by SEQ ID NO 807.

The invention also contemplates fragments of the isolated XBP1Δ4 protein.

XBP1Δ4 mRNA

In one aspect, the invention includes an isolated mRNA encoding the isolated XBP1Δ4 protein of the invention.

The isolated XBP1Δ4 mRNA may be a mammalian protein. In some embodiments, the XBP1Δ4 mRNA may be a hamster, mouse or human mRNA.

In certain embodiments, the isolated XBP1Δ4 mRNA is a hamster mRNA and is encoded by SEQ ID NO 6.

In certain embodiments, the isolated XBP1Δ4 mRNA is a mouse mRNA and is encoded by SEQ ID NO 595.

In certain embodiments, the isolated XBP1Δ4 mRNA is a human mRNA and is encoded by SEQ ID NO 806.

The invention also contemplates fragments of the isolated XBP1Δ4 mRNA.

Methods of Producing Polypeptides Using the Compound According to the Invention

The present inventors have identified that compounds, which induce the expression of XBP1Δ4 in mammalian cells, are useful in enhancing the recombinant expression of heterologously expressed proteins in mammalian cells, especially of multimeric polypeptides, such as antibodies.

As explained above, XBP1s is a functionally active protein which functions to enhance correct protein folding. The inventors have surprisingly determined that an XBP1 splice variant, such as XBP1Δ4, can enhance the production of correctly folded proteins in recombinant polypeptide production methods.

In one aspect the invention provides a method for (recombinantly) producing a polypeptide comprising the steps of:

a) cultivating a mammalian cell, which is expressing XBP1 and which comprises one or more nucleic acids encoding the polypeptide; and
b) recovering the polypeptide from the cells or the cultivation medium;

characterized in that the cultivating is at least in part in the presence of an antisense oligonucleotide, a composition, a pharmaceutical composition, a protein or an mRNA of the invention.

In one preferred embodiment, the cultivating comprises a pre- and a main-cultivating step, wherein at least the pre-cultivating step is performed in the presence of an oligonucleotide of the invention.

In certain embodiments, the method comprises the steps of:

a1) propagating a mammalian cell, which is expressing XBP1 and which comprises one or more nucleic acids encoding the polypeptide, in a cultivation medium-.comprising an antisense oligonucleotide according to the invention, to obtain a first cell population;
a2) mixing an aliquot of the first cell population with cultivation medium to obtain a second cell population, optionally wherein the cultivation medium comprises the antisense oligonucleotide according to the invention;
a3) cultivating the second cell population to obtain a third cell population; and
b) recovering the polypeptide from the cells and/or the cultivation medium of the third cell cultivation.

In certain embodiments, the antisense oligonucleotide is added to a final concentration of at least about 5 UM, at least about 10 μM, at least about 15 UM, at least about 20 UM, at least about 25 UM, at least about 30 UM, at least about 35 UM, at least about 40 UM, at least about 45 μM, at least about 50 UM or more. In one preferred embodiment, the antisense oligonucleotide is added to a final concentration of about 25 μM.

In certain embodiments, the propagating of the mammalian cell is performed at a starting cell density of at least about of 0.5*10E6 cells/mL, at least about of 1*10E6 cells/mL, at least about of 2*10E6 cells/mL, at least about of 3*10E6 cells/mL, at least about of 4*10E6 cells/mL, at least about of 5*10E6 cells/mL or more. In certain embodiments, the cultivation is performed at a starting cell density of 1*10E6 to 2*10E6 cells/mL.

In certain embodiments, the cultivation of the second cell population is performed at a starting cell density of at least about of 0.5*10E6 cells/mL, at least about of 1*10E6 cells/mL, at least about of 2*10E6 cells/mL, at least about of 3*10E6 cells/mL, at least about of 4*10E6 cells/mL, at least about of 5*10E6 cells/mL, at least about 10*10E6 cells/mL or more. In certain embodiments, the cultivation is performed at a starting cell density of 1*10E6 to 2*10E6 cells/mL.

In certain embodiments, the cell is a mammalian cell.

In certain embodiments, the cell is a hamster cell.

In certain embodiments, the cell is a CHO cell, such as a CHO-K1 cell. Chinese hamster ovary (CHO) cells are an epithelial cell line derived from the ovary of the Chinese hamster, often used in biological and medical research and commercially in the production of therapeutic proteins, such as monoclonal antibodies.

In some embodiments, the cell may be a human cell

In some embodiments, the cell may be a neuronal cell or a brain cell.

In some embodiments, the cell may be in vitro. The in vitro cell may for example be a iPSC cell.

In certain embodiments, the polypeptide is a Fab, preferably a bispecific Fab, an Fc-region comprising fusion polypeptide, a human therapeutic polypeptide, or a cytokine.

In certain embodiments, the polypeptide is an antibody. Here the antibody may take any form, as discussed in the definition of "antibody" provided herein.

In certain embodiments, the method of the invention provides for an increase in protein yield by at least about 10%, at least about 20%, at least about 30%, at least about 40%, at least about 50%, at least about 60%, at least about 70%, at least about 80%, at least about 90%, at least about 1000%, at least about 200%, at least about 300%, at least about 400%, at least about 500% or more, relative to the protein yield obtained in the absence of an antisense oligonucleotide of the invention.

In certain embodiments, the increase in yield represents an increase in the absolute amount of polypeptide. In other embodiments, the increase in yield represents an increase in the amount of correctly folded polypeptide. Herein a polypeptide can be defined as correctly folded either by viewing the structure of the polypeptide or by determining the polypeptide's activity.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

In one aspect, the invention relates to an antisense oligonucleotide, composition or pharmaceutical composition of the invention for use in medicine or therapy.

In some embodiments the therapy relates to the treatment or prevention of proteopathological disease.

In another aspect, the invention relates to use of an antisense oligonucleotide, composition or pharmaceutical composition of the invention in the manufacture of a medicament for the treatment of proteopathological disease.

In another aspect, the invention relates to a method for treating a proteopathological disease in a patient, the method comprising administering to the patient an antisense oligonucleotide, composition or pharmaceutical composition of the invention.

Proteopathological Diseases

In certain embodiments, the invention relates to the treatment or prevention of proteopathological diseases. Proteopathological diseases are also known as proteopathies, proteinopathies, protein conformational disorders, or protein mis-folding diseases.

In certain embodiments, the proteopathological disease may be selected from prion diseases, tautopathies, synucleinopathies, amyloidosis, multiple system atrophy, TDP-43 pathologies and CAG repeat indications.

In certain embodiments, the proteopathological disease may be selected from amyotrophic lateral sclerosis (ALS), frontotemporal lobar degeneration (FTLD), Alzheimer's disease, Parkinson's disease, Autism, Hippocampal sclerosis dementia, Down syndrome, Huntington's disease, polyglutamine diseases, such as spinocerebellar ataxia 3, myopathies and Chronic Traumatic Encephalopathy.

In certain embodiments the prior disease may be Creutzfeldt-Jakob disease.

In certain embodiments the tauopathy may be Alzheimer's disease.

In certain embodiments the synucleinopathy may be Parkinson's disease.

In certain embodiments the TDP-43 pathology may be amyotrophic lateral sclerosis (ALS) frontotemporal lobar degeneration (FTLD).

In certain embodiments the CAG repeat indication may be spinocerebellar ataxias, including spinocerebellar ataxia type 1, Spinocerebellar ataxia type 2 (SCA2), and Spinocerebellar ataxia type 3 (SCA3, Machado-Joseph disease).

Administration

The compounds, antisense oligonucleotides, compositions, pharmaceutical compositions, proteins or nucleic acids of the present invention may be administered topically or enterally or parenterally (such as, intravenous, subcutaneous, or intra-muscular).

In certain embodiments it is the antisense nucleic acid or pharmaceutical composition which is administered for therapy.

In a preferred embodiment, the antisense oligonucleotide or pharmaceutical compositions of the present invention are administered by a parenteral route including intravenous, intra-arterial, subcutaneous, intraperitoneal or intramuscular injection or infusion.

In one embodiment, the antisense nucleic acid or pharmaceutical composition are administered intravenously.

In another embodiment, the antisense nucleic acid or pharmaceutical composition is administered subcutaneously.

In some embodiments, the antisense nucleic acid or pharmaceutical composition of the invention is administered at a dose of 0.1-15 mg/kg, such as from 0.2-10 mg/kg, such as from 0.25-5 mg/kg. The administration can be once a week, every second week, every third week or even once a month.

NUMBERED EMBODIMENTS OF THE INVENTION

1. An antisense oligonucleotide for use in the expression of a XBP1 splice variant in a cell which expresses XBP1, wherein the antisense oligonucleotide is 8-40 nucleotides in length and comprises a contiguous nucleotide sequence of 8-40 nucleotides in length which is complementary to a mammalian XBP1 pre-mRNA transcript.

2. The antisense oligonucleotide according to embodiment 1, wherein the XBP1 splice variant is a XBP1Δ4 variant.

3. The antisense oligonucleotide according to embodiment 1 or embodiment 2, wherein the contiguous nucleotide sequence is complementary to at least 10 contiguous nucleotides of the hamster XBP1 pre-mRNA transcript (SEQ ID NO 1).

4. The antisense oligonucleotide according to embodiment 3, wherein the contiguous nucleotide sequence is complementary to at least 10 contiguous nucleotides from nucleotides 2960-3113 of SEQ ID NO 1.

5. The antisense oligonucleotide according to embodiment 4, wherein the contiguous nucleotide sequence is complementary to at least 10 contiguous nucleotides from nucleotides 2986-3018 of SEQ ID NO 1.

6. The antisense oligonucleotide according to embodiment 3, wherein the contiguous nucleotide sequence is complementary to a sequence selected from the group consisting of SEQ ID NO 299, SEQ ID NO 301, SEQ ID NO 302, SEQ ID NO 304, SEQ ID NO 305, SEQ ID NO 306, SEQ ID NO 307, SEQ ID NO 308, SEQ ID NO 309, SEQ ID NO 310, SEQ ID NO 314, SEQ ID NO 316, SEQ ID NO 317, SEQ ID NO 318, SEQ ID NO 319, SEQ ID NO 323, SEQ ID NO 325, SEQ ID NO 327, SEQ ID NO 328, SEQ ID NO 330, SEQ ID NO 331, SEQ ID NO 332, SEQ ID NO 333, SEQ ID NO 334, SEQ ID NO 336, SEQ ID NO 337, SEQ ID NO 385, SEQ ID NO 386, SEQ ID NO 387, SEQ ID NO 388, SEQ ID NO 390, SEQ ID NO 391, SEQ ID NO 392, SEQ ID NO 393, SEQ ID NO 394, SEQ ID NO 395, SEQ ID NO 396 397, SEQ ID NO 398, SEQ ID NO 399, SEQ ID NO 401, SEQ ID NO 402, SEQ ID NO 419, SEQ ID NO 431, SEQ ID NO, SEQ ID NO 432, SEQ ID NO 433, SEQ ID NO 434, SEQ ID NO 438, SEQ ID NO 439, SEQ ID NO 440, SEQ ID NO 441, SEQ ID NO 442, SEQ ID NO 449, SEQ ID NO 484, SEQ ID NO 485, SEQ ID NO 486, SEQ ID NO 487, SEQ ID NO 488, SEQ ID NO 489, SEQ ID NO 490, SEQ ID NO 491, SEQ ID NO 492, SEQ ID NO 493, SEQ ID NO 494, SEQ ID NO 495, SEQ ID NO 496, SEQ ID NO 497, SEQ ID NO 498, SEQ ID NO 499, SEQ ID NO 500, SEQ ID NO 501, SEQ ID NO 502, SEQ ID NO 503, SEQ ID NO 505, SEQ ID NO 506, SEQ ID NO 507, SEQ ID NO 508, SEQ ID NO 509, SEQ ID NO 510, SEQ ID NO 511, SEQ ID NO 512, SEQ ID NO 513, SEQ ID NO 515, SEQ ID NO 517, SEQ ID NO 520, SEQ ID NO 572, SEQ ID NO 573, SEQ ID NO 576, SEQ ID NO 577, SEQ ID NO 588 and SEQ ID NO 589.

7. The antisense oligonucleotide according to embodiment 6, wherein the contiguous nucleotide sequence is selected from the group consisting of SEQ ID NO 8, SEQ ID NO 10, SEQ ID NO 11, SEQ ID NO 13, SEQ ID NO 14, SEQ ID NO 15, SEQ ID NO 16, SEQ ID NO 17, SEQ ID NO 18, SEQ ID NO 19, SEQ ID NO 23, SEQ ID NO 24, SEQ ID NO 25, SEQ ID NO 26, SEQ ID NO 27, SEQ ID NO 28, SEQ ID NO 32, SEQ ID NO 34, SEQ ID NO 36, SEQ ID NO 37, SEQ ID NO 39, SEQ ID NO 40, SEQ ID NO 41, SEQ ID NO 42, SEQ ID NO 43, SEQ ID NO 45, SEQ ID NO 46, SEQ ID NO 94, SEQ ID NO 95, SEQ ID NO 96, SEQ ID NO 97, SEQ ID NO 99, SEQ ID NO 100, SEQ ID NO 101, SEQ ID NO 102, SEQ ID NO 103, SEQ ID NO 104, SEQ ID NO 105, SEQ ID NO 106, SEQ ID NO 107, SEQ ID NO 108, SEQ ID NO 110, SEQ ID NO 111, SEQ ID NO 128, SEQ ID NO 140, SEQ ID NO 141, SEQ ID NO 142, SEQ ID NO 143, SEQ ID NO 147, SEQ ID NO 148, SEQ ID NO 149, SEQ ID NO 150, SEQ ID NO 151, SEQ ID NO 158, SEQ ID NO 193, SEQ ID NO 194, SEQ ID NO 195, SEQ ID NO 196, SEQ ID NO 197, SEQ ID NO 198, SEQ ID NO 199, SEQ ID NO 200, SEQ ID NO 201, SEQ ID NO 202, SEQ ID NO 203, SEQ ID NO 204, SEQ ID NO 205, SEQ ID NO 206, SEQ ID NO 207, SEQ ID NO 208, SEQ ID NO 209, SEQ ID NO 210, SEQ ID NO 211, SEQ ID NO 212, SEQ ID NO 214, SEQ ID NO 215, SEQ ID NO 216, SEQ ID NO 217, SEQ ID NO 218, SEQ ID NO 219, SEQ ID NO 220, SEQ ID NO 221, SEQ ID NO 222, SEQ ID NO 224, SEQ ID NO 226, SEQ ID NO 229, SEQ ID NO 281, SEQ ID NO 282, SEQ ID NO 285, SEQ ID NO 286, SEQ ID NO 297 and SEQ ID NO 298.

8. The antisense oligonucleotide according to embodiment 3, wherein the contiguous nucleotide sequence is complementary to a sequence selected from the group consisting of SEQ ID NO 305, SEQ ID NO 307, SEQ ID NO 314, SEQ ID NO 315, SEQ ID NO 316, SEQ ID NO 317, SEQ ID NO 319, SEQ ID NO 331, SEQ ID NO 332, SEQ ID NO 392, SEQ ID NO 394, SEQ ID NO 395, SEQ ID NO 440, SEQ ID NO 492, SEQ ID NO 497, SEQ ID NO 498, SEQ ID NO 499, SEQ ID NO 500, SEQ ID NO 501, SEQ ID NO 502, SEQ ID NO 513 and SEQ ID NO 576.

9. The antisense oligonucleotide according to embodiment 8, wherein the contiguous nucleotide sequence is selected from the group consisting of SEQ ID NO 14, SEQ ID NO 16, SEQ ID NO 23, SEQ ID NO 24, SEQ ID NO 25, SEQ ID NO 26, SEQ ID NO 28, SEQ ID NO 40, SEQ ID NO 41, SEQ ID NO 101, SEQ ID NO 103, SEQ ID NO 104, SEQ ID NO 149, SEQ ID NO 201, SEQ ID NO 206, SEQ ID NO 207, SEQ ID NO 208, SEQ ID NO 209, SEQ ID NO 210, SEQ ID NO 211, SEQ ID NO 222 and SEQ ID NO 285.

10. The antisense oligonucleotide according to embodiment 3, wherein the contiguous nucleotide sequence is complementary to SEQ ID NO 314 or SEQ ID NO 315.

11. The antisense oligonucleotide according to embodiment 10, wherein the contiguous nucleotide sequence is SEQ ID 23 or SEQ ID 24.

12. The antisense oligonucleotide according to embodiment 1 or embodiment 2, wherein the contiguous nucleotide sequence is complementary to at least 10 contiguous nucleotides from the mouse XBP1 pre-mRNA transcript (SEQ ID NO 590).

13. The antisense oligonucleotide according to embodiment 12, wherein the contiguous nucleotide sequence is complementary to at least 10 contiguous nucleotides from nucleotides 3560-3783 of SEQ ID NO 590.

14. The antisense oligonucleotide according to embodiment 12, wherein the contiguous nucleotide sequence is complementary to a sequence selected from the group consisting of SEQ ID NO 699, SEQ ID NO 700, SEQ ID NO 703, SEQ ID NO 710, SEQ ID NO 713, SEQ ID NO 724, SEQ ID NO 729, SEQ ID NO 739, SEQ ID NO 743, SEQ ID NO 744, SEQ ID NO 745, SEQ ID NO 749, SEQ ID NO 750, SEQ ID NO 751, SEQ ID NO 752, SEQ ID NO 753, SEQ ID NO 754, SEQ ID NO 755, SEQ ID NO 756, SEQ ID NO 757, SEQ ID NO 758, SEQ ID NO 759, SEQ ID NO 760, SEQ ID NO 761, SEQ ID NO 762, SEQ ID NO 763, SEQ ID NO 773, SEQ ID NO 776, SEQ ID NO 778, SEQ ID NO 781, SEQ ID NO 783, SEQ ID NO 784, SEQ ID NO 785, SEQ ID NO 787, SEQ ID NO 789, SEQ ID NO 790, SEQ ID NO 791, SEQ ID NO 792, SEQ ID NO 793, SEQ ID NO 794, SEQ ID NO 795, SEQ ID NO 796, SEQ ID NO 797, SEQ ID NO 798, SEQ ID NO 799 and SEQ ID NO 800.

15. The antisense oligonucleotide according to embodiment 14, wherein the contiguous nucleotide sequence is selected from the group consisting of SEQ ID NO 597, SEQ ID NO 598, SEQ ID NO 601, SEQ ID NO 608, SEQ ID NO 611, SEQ ID NO 622, SEQ ID NO 627, SEQ ID NO 637, SEQ ID NO 641, SEQ ID NO 642, SEQ ID NO 643, SEQ ID NO 647, SEQ ID NO 648, SEQ ID NO 649, SEQ ID NO 650, SEQ ID NO 651, SEQ ID NO 652, SEQ ID NO 653, SEQ ID NO 654, SEQ ID NO 655, SEQ ID NO 656, SEQ ID NO 657, SEQ ID NO 658, SEQ ID NO 659, SEQ ID NO 660, SEQ ID NO 661, SEQ ID NO 671, SEQ ID NO 674, SEQ ID NO 676, SEQ ID NO 679, SEQ ID NO 681, SEQ ID NO 682, SEQ ID NO 683, SEQ ID NO 685, SEQ ID NO 687, SEQ ID NO 688, SEQ ID NO 689, SEQ ID NO 690, SEQ ID NO 691, SEQ ID NO 692, SEQ ID NO 693, SEQ ID NO 694, SEQ ID NO 695, SEQ ID NO 696, SEQ ID NO 697 and SEQ ID NO 698.

16. The antisense oligonucleotide according to embodiment 12, wherein the contiguous nucleotide sequence is complementary to a sequence selected from the group consisting of SEQ ID NO 710, SEQ ID NO 754, SEQ ID NO 756, SEQ ID NO 757, SEQ ID NO 758, SEQ ID NO 759, SEQ ID NO 760, SEQ ID NO 791, SEQ ID NO 792, SEQ ID NO 794, SEQ ID NO 795 and SEQ ID NO 797.

17. The antisense oligonucleotide according to embodiment 16, wherein the contiguous nucleotide sequence is selected from the group consisting of SEQ ID NO 608, SEQ ID NO 652, SEQ ID NO 654, SEQ ID NO 655, SEQ ID NO 656, SEQ ID NO 657, SEQ ID NO 658, SEQ ID NO 689, SEQ ID NO 690, SEQ ID NO 692, SEQ ID NO 693 and SEQ ID NO 695.

18. The antisense oligonucleotide according to embodiment 1 or embodiment 2, wherein the contiguous nucleotide sequence is complementary to at least 10 contiguous nucleotides of the human XBP1 pre-mRNA transcript (SEQ ID NO 801).

19. The antisense oligonucleotide according to embodiment 18, wherein the contiguous nucleotide sequence is complementary to at least 10 contiguous nucleotides from nucleotides 4338-4563 of SEQ ID NO 801.

20. The antisense oligonucleotide according to embodiment 18, wherein the contiguous nucleotide sequence is complementary to a sequence selected from the group consisting of SEQ ID NO 947, SEQ ID NO 948, SEQ ID NO 949, SEQ ID NO 950, SEQ ID NO 951 and SEQ ID NO 988.

21. The antisense oligonucleotide according to embodiment 21, wherein the contiguous nucleotide sequence is selected from the group consisting of SEQ ID NO 854, SEQ ID NO 855, SEQ ID NO 856, SEQ ID NO 857, SEQ ID NO 858 and SEQ ID NO 895.

22. The antisense oligonucleotide according to embodiment 18, wherein the contiguous nucleotide sequence is complementary to SEQ ID NO 951.

23. The antisense oligonucleotide according to embodiment 22, wherein the contiguous nucleotide sequence is SEQ ID NO 858.

24. The antisense oligonucleotide according to any one of the preceding embodiments, wherein the antisense oligonucleotide or contiguous nucleotide sequence thereof is fully complementary to a mammalian XBP1 pre-mRNA transcript.

25. The antisense oligonucleotide according to any one of the preceding embodiments, wherein the contiguous nucleotide sequence is at least 12 nucleotides in length.

26. The antisense oligonucleotide according to embodiment 25, wherein the contiguous nucleotide sequence is 12-16 or 12-18 nucleotides in length.

27. The antisense oligonucleotide according embodiment 25, wherein the contiguous nucleotide sequence is 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length.

28. The antisense oligonucleotide according to any one of the preceding embodiments, wherein the contiguous nucleotide sequence is the same length as the antisense oligonucleotide.

29. The antisense oligonucleotide according to any one of the preceding embodiments, wherein the antisense oligonucleotide is isolated, purified or manufactured.

30. The antisense oligonucleotide according to any one of the preceding embodiment, wherein the antisense oligonucleotide or contiguous nucleotide sequence thereof comprises one or more modified nucleotides or one or more modified nucleosides.

31. The antisense oligonucleotide according to any one of the preceding embodiments, wherein the antisense oligonucleotide or contiguous nucleotide sequence thereof comprises one or more modified nucleosides, such as one or more modified nucleotides independently selected from the group consisting of 2'-O-alkyl-RNA; 2'-O-methyl RNA (2'-OMe); 2'-alkoxy-RNA; 2'-O-methoxyethyl-RNA (2'-MOE); 2'-amino-DNA; 2'-fluro-RNA; 2'-fluoro-DNA; arabino nucleic acid (ANA); 2'-fluoro-ANA; bicyclic nucleoside analog (LNA); or any combination thereof.

32. The antisense oligonucleotide according to embodiment 30 or embodiment 31, wherein one or more of the modified nucleosides is a sugar modified nucleoside.

33. The antisense oligonucleotide according to any one of embodiments 30 to 32, wherein one or more of the modified nucleosides comprises a bicyclic sugar.

34. The antisense oligonucleotide according to any one of embodiments 30 to 32, wherein one or more of the modified nucleosides is an affinity enhancing 2' sugar modified nucleoside.

35. The antisense oligonucleotide according to any one of embodiments 30 to 34, wherein one or more of the modified nucleosides is an LNA nucleoside, such as one or more beta-D-oxy LNA nucleosides.

36. The antisense oligonucleotide according to any one of the preceding embodiments, wherein the antisense oligonucleotide or contiguous nucleotide sequence thereof comprises one or more 5'-methyl-cytosine nucleobases.

37. The antisense oligonucleotide according to any one of the preceding embodiments, wherein one or more of the internucleoside linkages within the contiguous nucleotide sequence of the antisense oligonucleotide are modified.

38. The antisense oligonucleotide according to embodiment 37, wherein at least about 75%, at least about 80%, at least about 85%, at least about 90%, at least about 95% or about 100% of the internucleoside linkages are modified.

39. The antisense oligonucleotide according to embodiment 37 or embodiment 38, wherein the one or more modified internucleoside linkages comprise a phosphorothioate linkage.

40. The antisense oligonucleotide according to any one of the preceding embodiments, wherein the antisense oligonucleotide is a morpholino modified antisense oligonucleotide.

41. The antisense oligonucleotide according to any one of the preceding embodiments, wherein the antisense oligonucleotide or contiguous nucleotide sequence thereof is or comprises an antisense oligonucleotide mixmer or totalmer.

42. An antisense oligonucleotide according to any one of the preceding embodiments covalently attached to at least one conjugate moiety.

43. The antisense oligonucleotide according to embodiment 42, wherein the conjugate moiety comprises a protein, a fatty acid chain, a sugar residue, a glycoprotein, a polymer or any combination thereof.

44. The antisense oligonucleotide according to any one of the preceding embodiments, wherein the antisense oligonucleotide is in the form of a pharmaceutically acceptable salt.

45. The antisense oligonucleotide according to embodiment 44, wherein the salt is a sodium salt, a potassium salt or an ammonium salt.

46. A composition comprising the antisense oligonucleotide according to any one of the preceding embodiments.

47. A pharmaceutical composition comprising the antisense oligonucleotide according to any one of embodiments 1 to 45 and a pharmaceutically acceptable diluent, solvent, carrier, salt and/or adjuvant.

48. The pharmaceutical composition according to embodiment 47, wherein the pharmaceutical composition comprises an aqueous diluent or solvent, such as phosphate buffered saline.

49. An isolated XBP1Δ4 protein.

50. The isolated XBP1Δ4 protein according to embodiment 49, wherein the protein comprises the sequence of SEQ ID NO: 7, SEQ ID NO: 596 or SEQ ID NO 807.

51. An isolated mRNA encoding the XBP1Δ4 protein according to embodiment 49 or embodiment 50 52. The isolated mRNA according to embodiment 51, comprising the sequence of SEQ ID NO: 6, SEQ ID NO: 595 or SEQ ID NO: 806.

53. A method for producing a polypeptide comprising the steps of:

a) cultivating a mammalian cell, which is expressing XBP1 and which comprises one or more nucleic acids encoding the polypeptide; and b) recovering the polypeptide from the cells or the cultivation medium, characterized in that the cultivating is in the presence of an antisense oligonucleotide according to any one of embodiments 1 to 45, a composition according to embodiment 46, a pharmaceutical composition according to embodiment 47 or embodiment 48, a protein according to embodiment 49 or 50 or an mRNA according to embodiment 51 or 52.

54. The method according to embodiment 53, comprising the steps of:

a1) propagating a mammalian cell, which is expressing XBP1 and which comprises one or more nucleic acids encoding the polypeptide, in a cultivation medium comprising an antisense oligonucleotide according to any one of embodiments 1 to 45, to obtain a first cell population;

a2) mixing an aliquot of the first cell population with cultivation medium to obtain a second cell population, wherein the cultivation medium optionally comprises the antisense oligonucleotide according to any one of embodiments 1 to 45;

a3) cultivating the second cell population to obtain a third cell population; and b) recovering the polypeptide from the cells and/or the cultivation medium of the third cell cultivation.

55. The method according to embodiment 53 or embodiment 54, wherein the antisense oligonucleotide is added to a final concentration of 25 UM or more.

56. The method according to any one of embodiments 53 to 55, wherein the propagating and/or the cultivating is with a starting cell density of 1*10E6 to 2*10E6 cells/mL.

57. The method according to embodiment 56, wherein the starting cell density is about 2*10E6 cells/mL.

58. The method according to any one of embodiments 53 to 57, wherein the mammalian cell is a CHO cell.

59. The method according to any one of embodiments 53 to 58, wherein the polypeptide is an antibody.

60. An antisense oligonucleotide according to any one of embodiments 1 to 45, a composition according to embodiment 46 or a pharmaceutical composition according to embodiment 47 or embodiment 48 for use in medicine.

61. An antisense oligonucleotide according to any one of embodiments 1 to 45, a composition according to embodiment 46 or a pharmaceutical composition according to embodiment 47 or embodiment 48 for use in the treatment of patient with a proteopathological disease.

62. The antisense oligonucleotide for use according to embodiment 61, wherein the proteopathological disease has TDP-43 pathology.

63. The antisense oligonucleotide for use according to embodiment 61 or embodiment 62, wherein the proteopathological disease is motor neuron disease or frontotemporal lobar degeneration.

64. The use of an antisense oligonucleotide according to any one of embodiments 1 to 45, a composition according to embodiment 46 or a pharmaceutical composition according to embodiment 47 or embodiment 48 in the manufacture of a medicament for the treatment of proteopathological disease.

65. The use according to embodiment 64, wherein the disease has disease TDP-43 pathology.

66. The use according to embodiment 64 or embodiment 65, wherein the disease is motor neuron disease or frontotemporal lobar degeneration.

67. A method for treating a proteopathological disease in a patient, the method comprising administering to the patient an antisense oligonucleotide according to any one of embodiments 1 to 45, a composition according to embodiment 46 or a pharmaceutical composition according to embodiment 47 or embodiment 48.

68. The method according to embodiment 67, wherein the disease has TDP-43 pathology.

69. The method according to embodiment 67 or embodiment 68, wherein the disease is motor neuron disease or frontotemporal lobar degeneration.

EXAMPLES

General Techniques

Recombinant DNA Techniques

Standard methods were used to manipulate DNA as described in Sambrook et al., Molecular Cloning: A Laboratory Manual, Second Edition, Cold Spring Harbor Laboratory Press, Cold Spring Harbor, N.Y, (1989). The molecular biological reagents were used according to the manufacturer's instructions.

Gene Synthesis

Desired gene segments were prepared by chemical synthesis at Geneart GmbH (Regensburg, Germany). The synthesized gene fragments were cloned into an *E. coli* plasmid for propagation/amplification. The DNA sequences of subcloned gene fragments were verified by DNA sequencing. Alternatively, short synthetic DNA fragments were assembled by annealing chemically synthesized oligonucleotides or via PCR. The respective oligonucleotides were prepared by metabion GmbH (Planegg-Martinsried, Germany).

DNA Sequence Determination

DNA sequences were determined by double strand sequencing performed at MediGenomix GmbH (Martinsried, Germany) or SequiServe GmbH (Vaterstetten, Germany).

DNA and Protein Sequence Analysis and Sequence Data Management

The EMBOSS (European Molecular Biology Open Software Suite) software package and Invitrogen's Vector NTI version 11.5 or Geneious prime were used for sequence creation, mapping, analysis, annotation and illustration.

Reagents

All commercial chemicals, antibodies and kits were used as provided according to the manufacturer's protocol if not stated otherwise.

Protein Determination

The protein concentration of purified antibodies and derivatives was determined by determining the optical density (OD) at 280 nm, using the molar extinction coefficient calculated on the basis of the amino acid sequence according to Pace, et al., Protein Science 4 $(1995)_{2411}$-1423.

Antibody Concentration Determination in Supernatants

The concentration of antibodies in cell culture supernatants was estimated by immunoprecipitation with protein A agarose-beads (Roche Diagnostics GmbH, Mannheim, Germany). Therefore, 60 μL protein A Agarose beads were washed three times in TBS-NP40 (50 mM Tris buffer, pH 7.5, supplemented with 150 mM NaCl and 1% Nonidet-P40). Subsequently, 1-15 mL cell culture supernatant was applied to the protein A Agarose beads pre-equilibrated in TBS-NP40. After incubation for at 1 hour at room temperature the beads were washed on an Ultrafree-MC-filter column (Amicon) once with 0.5 mL TBS-NP40, twice with 0.5 mL 2× phosphate buffered saline (2×PBS, Roche Diagnostics GmbH, Mannheim, Germany) and briefly four times with 0.5 mL 100 mM Na-citrate buffer (pH 5.0). Bound antibody was eluted by addition of 35 μl NuPAGE® LDS sample buffer (Invitrogen). Half of the sample was combined with NuPAGE® sample reducing agent or left unreduced, respectively, and heated for 10 min at 70° C. Consequently, 5-30 μl were applied to a 4-12% NuPAGE® Bis-Tris SDS-PAGE gel (Invitrogen) (with MOPS buffer for non-reduced SDS-PAGE and MES buffer with NuPAGE® antioxidant running buffer additive (Invitrogen) for reduced SDS-PAGE) and stained with Coomassie Blue.

The concentration of the antibodies in cell culture supernatants was quantitatively measured by affinity HPLC chromatography. Briefly, cell culture supernatants containing antibodies that bind to protein A were applied to an Applied Biosystems Poros A/20 column in 200 mM KH2PO4, 100 mM sodium citrate, pH 7.4 and eluted with 200 mM NaCl, 100 mM citric acid, pH 2.5 on an Agilent HPLC 1100 system. The eluted antibody was quantified by UV absorbance and integration of peak areas. A purified standard IgG1 antibody served as a standard.

Alternatively, the concentration of antibodies and derivatives in cell culture supernatants was measured by Sandwich-IgG-ELISA. Briefly, StreptaWell™ High Bind Streptavidin A-96 well microtiter plates (Roche Diagnostics GmbH, Mannheim, Germany) were coated with 100 μL/well biotinylated anti-human IgG capture molecule $F(ab')_2$<h-Fcγ>BI (Dianova) at 0.1 μg/mL for 1 hour at room temperature or alternatively overnight at 4° C. and subsequently washed three times with 200 μL/well PBS, 0.05% Tween (PBST, Sigma). Thereafter, 100 ρL/well of a dilution series in PBS (Sigma) of the respective antibody containing cell culture supernatants was added to the wells and incubated for 1-2 hour on a shaker at room temperature. The wells were washed three times with 200 μL/well PBST and bound antibody was detected with 100 μl $F(ab')_2$<hFcγ>POD (Dianova) at 0.1 μg/mL as the detection antibody by incubation for 1-2 hours on a shaker at room temperature. Unbound detection antibody was removed by washing three times with 200 μL/well PBST. The bound detection antibody was detected by addition of 100 μL ABTS/well followed by incubation. Determination of absorbance was performed on a Tecan Fluor Spectrometer at a measurement wavelength of 405 nm (reference wavelength 492 nm).

Cultivation of CHO Host Cell Line

CHO host cells were cultivated at 37° C. in a humidified incubator with 85% humidity and 5% $CO_2$. They were cultivated in a proprietary DMEM/F12-based medium containing 300 μg/ml Hygromycin B and 4 μg/ml of a second selection marker. The cells were split every 3 or 4 days at a concentration of 0.3×10E6 cells/ml in a total volume of 30 ml. For the cultivation 125 ml non-baffle Erlenmeyer shake flasks were used. Cells were shaken at 150 rpm with a shaking amplitude of 5 cm. The cell count was determined with Cedex HiRes Cell Counter (Roche). Cells were kept in culture until they reached an age of 60 days.

Transformation 10-Beta Competent *E. coli* Cells

For transformation, the 10-beta competent *E. coli* cells were thawed on ice. After that, 2 μl of plasmid DNA were pipetted directly into the cell suspension. The tube was flicked and put on ice for 30 minutes. Thereafter, the cells were placed into the 42° C.-warm thermal block and heat-shocked for exactly 30 seconds. Directly afterwards, the cells were chilled on ice for 2 minutes. 950 μl of NEB 10-beta outgrowth medium were added to the cell suspension. The cells were incubated under shaking at 37° C. for one hour. Then, 50-100 μl were pipetted onto a pre-warmed (37° C.) LB-Amp agar plate and spread with a disposable spatula. The plate was incubated overnight at 37° C. Only bacteria, which have successfully incorporated the plasmid, carrying the resistance gene against ampicilin, can grow on these plates. Single colonies were picked the next day and cultured in LB-Amp medium for subsequent plasmid preparation.

Bacterial Culture

Cultivation of *E. coli* was done in LB-medium, short for Luria Bertani, which was spiked with 1 ml/L 100 mg/ml ampicillin resulting in an ampicilin concentration of 0.1 mg/ml. For the different plasmid preparation quantities, the following amounts were inoculated with a single bacterial colony.

TABLE 1

*E. coli* cultivation volumes

| Quantity plasmid preparation | Volume LB-Amp medium [ml] | Incubation time [h] |
|---|---|---|
| Mini-Prep 96-well (EpMotion) | 1.5 | 23 |
| Mini-Prep 15 ml-tube | 3.6 | 23 |
| Maxi-Prep | 200 | 16 |

For Mini-Prep, a 96-well 2 ml deep-well plate was filled with 1.5 ml LB-Amp medium per well. The colonies were picked and the toothpick was tuck in the medium. When all colonies were picked, the plate closed with a sticky air porous membrane. The plate was incubated in a 37° C. incubator at a shaking rate of 200 rpm for 23 hours.

For Mini-Preps a 15 ml-tube (with a ventilated lid) was filled with 3.6 ml LB-Amp medium and equally inoculated with a bacterial colony. The toothpick was not removed but left in the tube during incubation. Like the 96-well plate, the tubes were incubated at 37° C., 200 rpm for 23 hours.

For Maxi-Prep 200 ml of LB-Amp medium were filled into an autoclaved glass 1.L Erlenmeyer flask and inoculated with 1 ml of bacterial day-culture, which was roundabout 5 hours old. The Erlenmeyer flask was closed with a paper plug and incubated at 37° C., 200 rpm for 16 hours.

Plasmid Preparation

For Mini-Prep, 50 μl of bacterial suspension were transferred into a 1 ml deep-well plate. After that, the bacterial cells were centrifuged down in the plate at 3000 rpm, 4° C. for 5 min. The supernatant was removed and the plate with the bacteria pellets placed into an EpMotion. After approx. 90 minutes, the run was done and the eluted plasmid-DNA could be removed from the EpMotion for further use.

For Mini-Prep, the 15 ml tubes were taken out of the incubator and the 3.6 ml bacterial culture split into two 2 ml Eppendorf tubes. The tubes were centrifuged at 6,800×g in a table-top microcentrifuge for 3 minutes at room temperature. After that, Mini-Prep was performed with the Qiagen QIAprep Spin Miniprep Kit according to the manufacturer's instructions. The plasmid DNA concentration was measured with Nanodrop.

Maxi-Prep was performed using the Macherey-Nagel NucleoBond® Xtra Maxi EF Kit according to the manufacturer's instructions. The DNA concentration was measured with Nanodrop.

Ethanol Precipitation

The volume of the DNA solution was mixed with the 2.5-fold volume ethanol 100%. The mixture was incubated at −20° C. for 10 min. Then the DNA was centrifuged for 30 min. at 14,000 rpm, 4° C. The supernatant was carefully removed and the pellet washed with 70% ethanol. Again, the tube was centrifuged for 5 min. at 14,000 rpm, 4° C. The supernatant was carefully removed by pipetting and the pellet dried. When the ethanol was evaporated, an appropriate amount of endotoxin-free water was added. The DNA was given time to re-dissolve in the water overnight at 4° C. A small aliquot was taken and the DNA concentration was measured with a Nanodrop device.

Preparative Antibody Purification

Antibodies were purified from filtered cell culture supernatants referring to standard protocols. In brief, antibodies were applied to a protein A Sepharose column (GE healthcare) and washed with PBS. Elution of antibodies was achieved at pH 2.8 followed by immediate neutralization. Aggregated protein was separated from monomeric antibodies by size exclusion chromatography (Superdex 200, GE Healthcare) in PBS or in 20 mM Histidine buffer comprising 150 mM NaCl (pH 6.0). Monomeric antibody fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.:

SDS-PAGE

The NuPAGE® Pre-Cast gel system (Invitrogen) was used according to the manufacturer's instruction. In particular, 10% or 4-12% NuPAGE® Novex® Bis-TRIS Pre-Cast gels (pH 6.4) and a NuPAGE® MES (reduced gels, with NuPAGE® antioxidant running buffer additive) or MOPS (non-reduced gels) running buffer was used.

CE-SDS

Purity and antibody integrity were analyzed by CE-SDS using microfluidic Labchip technology (PerkinElmer, USA). Therefore, 5 µl of antibody solution was prepared for CE-SDS analysis using the HT Protein Express Reagent Kit according manufacturer's instructions and analyzed on Labchip GXII system using a HT Protein Express Chip. Data were analyzed using Labchip GX Software.

Analytical Size Exclusion Chromatography

Size exclusion chromatography (SEC) for the determination of the aggregation and oligomeric state of antibodies was performed by HPLC chromatography. Briefly, protein A purified antibodies were applied to a Tosoh TSKgel G3000SW column in 300 mM NaCl, 50 mM KH2PO4/K2HPO4 buffer (pH 7.5) on an Dionex Ultimate® system (Thermo Fischer Scientific), or to a Superdex 200 column (GE Healthcare) in 2×PBS on a Dionex HPLC-System. The eluted antibody was quantified by UV absorbance and integration of peak areas. BioRad Gel Filtration Standard 151-1901 served as a standard.

Mass Spectrometry

This section describes the characterization of the bispecific antibodies with emphasis on their correct assembly. The expected primary structures were analyzed by electrospray ionization mass spectrometry (ESI-MS) of the deglycosylated intact antibody and in special cases of the deglycosylated/limited LysC digested antibody.

The antibodies were deglycosylated with N-Glycosidase F in a phosphate or Tris buffer at 37° C. for up to 17 h at a protein concentration of 1 mg/ml. The limited LysC (Roche Diagnostics GmbH, Mannheim, Germany) digestions were performed with 100 µg deglycosylated antibody in a Tris buffer (pH 8) at room temperature for 120 hours, or at 37° C. for 40 min, respectively. Prior to mass spectrometry the samples were desalted via HPLC on a Sephadex G25 column (GE Healthcare). The total mass was determined via ESI-MS on a maXis 4G UHR-QTOF MS system (Bruker Daltonik) equipped with a TriVersa NanoMate source (Advion).

Example 1: Identification of Oligonucleotide to Induce Splice Skipping of Exon in the Hamster XBP1 mRNA, to Make a XBP1 Protein Mimic that Works Similarly to the Naturally Processed XBP1 Protein CHOK1 cells were obtained from the ATCC cell bank, and were grown and maintained according to ATCC guidelines. 40 ASOs complementary to a region around exon 4 of the XBP1 mRNA NM_001244047.1 were tested for the ability to induce exon skipping of exon 4.

5000 cells CHOK1 cells were seeded in a 96 well plate, 6 hours later the ASOs were added directly to the cell medium at a final concentration of 5 UM and 25 µM. Cells were cultivated and harvested after 6 days and total RNA was isolated using the RNeasy 96 well kit from Qiagen according to manufacturer's instructions.

cDNA was generated using the iScript™ Advanced cDNA Synthesis Kit for RT-qPCR from Biorad. Relative mRNA expression was measured by droplet digital PCR using the QX200 ddPCR system from Biorad along with the automated droplet generator AutoDG from Biorad.

PCR was performed using the ddPCR supermix for probes (no UTP) from Biorad according to manufacturer's instructions.

The following primers and probes were used to measure the amount of mRNAs with exon skipping of exon 4 (XBP1 A 4 assay) and the amount of mRNA with normal joining of exon 4 and 5 (XBP1 WT) both purchased from IDT technologies. The XBP1 WT assay detected both the IRE-1 processed and unprocessed mRNA.

```
XBP1WT assay:
                                        (SEQ ID NO: 1497)
Primer 2 (GTTCCTCCAGATTGGCAG)

                                        (SEQ ID NO: 1498)
Primer 1 (CCAGGAGTTAAGAACTCGC)

                                        (SEQ ID NO: 1499)
Probe /HEX/CGGAGTCCA /ZEN/ AGGGAAATGGAGTA/3IABkFQ/

XBP1Δ4 assay:
                                        (SEQ ID NO: 1500)
Primer 2 (GTTCCTCCAGATTGGCAG)

                                        (SEQ ID NO: 1501)
Primer 1 (CCAGGAGTTAAGAACTCGC)

                                        (SEQ ID NO: 1502)
/56-FAM/CGGAGTCCA /ZEN/ AGTCTGATATCCTTTTG/3IABkFQ/
```

Data was analyzed using the QuantaSoft™ Analysis Pro software from Biorad. The percentile of mRNAs containing skipping of exon 4, was calculated by (concA4/(concΔ4+concWT))*100. The normal percentile of mRNA with exon 4 skipping was calculated from the average of 14 control wells treated with PBS only. The average of PBS wells was 0.6%. The data are shown in Table 2.

TABLE 2

| % of Xbp1 mRNA with exon 4 skipping. | | |
|---|---|---|
| ASO Used | 5 µM | 25 µM |
| SEQ ID 8 | 0.0 | 2.4 |
| SEQ ID 9 | 0.0 | 0.0 |

TABLE 2-continued

% of Xbp1 mRNA with exon 4 skipping.

| ASO Used | 5 μM | 25 μM |
|---|---|---|
| SEQ ID 10 | 0.0 | 1.0 |
| SEQ ID 11 | 0.8 | 2.2 |
| SEQ ID 12 | 0.8 | 0.0 |
| SEQ ID 13 | 2.7 | 1.0 |
| SEQ ID 14 | 0.0 | 6.1 |
| SEQ ID 15 | 0.0 | 1.5 |
| SEQ ID 16 | 7.9 | 10.6 |
| SEQ ID 17 | 2.4 | 1.3 |
| SEQ ID 18 | 1.3 | 3.3 |
| SEQ ID 19 | 0.0 | 1.0 |
| SEQ ID 20 | 0.0 | 0.0 |
| SEQ ID 21 | 0.9 | 0.0 |
| SEQ ID 22 | 0.0 | 0.0 |
| SEQ ID 23 | 1.1 | 9.1 |
| SEQ ID 24 | 11.2 | 25.9 |
| SEQ ID 25 | 4.6 | 16.5 |
| SEQ ID 26 | 4.6 | 5.3 |
| SEQ ID 27 | 2.5 | 3.5 |
| SEQ ID 28 | 4.7 | 11.1 |
| SEQ ID 29 | 0.0 | 0.0 |
| SEQ ID 30 | 0.0 | 0.9 |
| SEQ ID 31 | 0.0 | 0.9 |
| SEQ ID 32 | 1.0 | 1.8 |
| SEQ ID 33 | 0.0 | 0.0 |
| SEQ ID 34 | 0.0 | 3.2 |
| SEQ ID 35 | 0.0 | 0.0 |
| SEQ ID 36 | 0.0 | 1.6 |
| SEQ ID 37 | 1.1 | 1.1 |
| SEQ ID 38 | 0.0 | 0.0 |
| SEQ ID 39 | 0.0 | 2.3 |
| SEQ ID 40 | 0.0 | 6.8 |
| SEQ ID 41 | 0.0 | 10.0 |
| SEQ ID 42 | 1.1 | 2.1 |
| SEQ ID 43 | 0.0 | 1.2 |
| SEQ ID 44 | 0.0 | 0.0 |
| SEQ ID 45 | 0.0 | 3.3 |
| SEQ ID 46 | 1.6 | 0.0 |
| SEQ ID 47 | 0.0 | 0.0 |

Example 2: Identification of ASO to Induce Splice Skipping of Exon in the Hamster XBP1 mRNA, to Make a XBP1 Protein Mimic that Works Similar to the Naturally Processed XBP1 Protein, Now with an Extended Library Covering More Sequences Near Exon 4

CHOK1 cells were obtained from the ATCC cell bank, and were grown and maintained according to ATCC guidelines. 251 ASOs complementary to a region around exon 4 of the XBP1 mRNA NM_001244047.1 were tested for the ability to induce exon skipping of exon 4.

3000 CHOK1 cells were seeded in a 96 well plate, 24 hours later the ASOs were added directly to the cell medium at a final concentration of 5 UM and 25 μM. Cells were harvested after 6 days and total RNA was isolated using the RNeasy 96 well kit from Qiagen according to manufactures instructions.

cDNA was generated using the iScript™ Advanced cDNA Synthesis Kit for RT-qPCR from Biorad. Relative mRNA expression was measured by droplet digital PCR using the QX200 ddPCR™ system from Biorad along with the automated droplet generator AutoDG from Biorad.

PCR was performed using the ddPCR supermix for probes (no UTP) from Biorad according to manufactories instructions.

The following primers and probes were used to measure the amount of mRNAs with exon skipping of exon4 (XBP1Δ4 assay) and the amount of mRNA with normal joining of exon 4 and 5 (XBP1 WT) both purchased from IDT technologies. The XBP1 WT assay detected both the IRE-1 processed and unprocessed mRNA.

```
XBP1 WT assay:
                                        (SEQ ID NO: 1497)
Primer 2 (GTTCCTCCAGATTGGCAG)

                                        (SEQ ID NO: 1498)
Primer 1 (CCAGGAGTTAAGAACTCGC)

                                        (SEQ ID NO: 1499)
Probe /HEX/CGGAGTCCA /ZEN/ AGGGAAATGGAGTA/3IABkFQ/

XBP1Δ4 assay:
                                        (SEQ ID NO: 1500)
Primer 2 (GTTCCTCCAGATTGGCAG)

                                        (SEQ ID NO: 1501)
Primer 1 (CCAGGAGTTAAGAACTCGC)

                                        (SEQ ID NO: 1502)
/56-FAM/CGGAGTCCA /ZEN/ AGTCTGATATCCTTTTG/3IABkFQ/
```

Data was analyzed using the QuantaSoft™ Analysis Pro software from Biorad. The percentile of mRNAs containing skipping of exon 4, was calculated by (concΔ4/(concΔ4+concWT))*100. The normal percentile of mRNA with exon 4 skipping was calculated from the average of 170 control wells treated with PBS only. The average of PBS wells were 0.1%. The data is shown in Table 3.

TABLE 3

% of Xbp1 mRNA with exon 4 skipping of 2 library.

| Oligo ID | 5 μM | 25 μM |
|---|---|---|
| SEQ ID 48 | 0.00 | 0.54 |
| SEQ ID 49 | 0.00 | 0.18 |
| SEQ ID 50 | 0.18 | 0.00 |
| SEQ ID 51 | 0.00 | 0.00 |
| SEQ ID 52 | 0.00 | 0.17 |
| SEQ ID 53 | 0.00 | 0.00 |
| SEQ ID 54 | 0.00 | 0.00 |
| SEQ ID 55 | 0.00 | 0.00 |
| SEQ ID 56 | 0.16 | 0.31 |
| SEQ ID 57 | 0.15 | 0.32 |
| SEQ ID 58 | 0.00 | 0.15 |
| SEQ ID 59 | 0.00 | 0.14 |
| SEQ ID 60 | 0.00 | 0.13 |
| SEQ ID 61 | 0.00 | 0.00 |
| SEQ ID 62 | 0.00 | 0.00 |
| SEQ ID 63 | 0.33 | 0.00 |
| SEQ ID 64 | 0.00 | 0.00 |
| SEQ ID 65 | 0.00 | 0.16 |
| SEQ ID 66 | 0.00 | 0.15 |
| SEQ ID 67 | 0.00 | 0.00 |
| SEQ ID 68 | 0.35 | 0.00 |
| SEQ ID 69 | 0.13 | 0.00 |
| SEQ ID 70 | 0.17 | 0.18 |
| SEQ ID 71 | 0.00 | 0.00 |
| SEQ ID 72 | 0.48 | 0.92 |
| SEQ ID 73 | 0.14 | 0.00 |
| SEQ ID 74 | 0.00 | 0.00 |
| SEQ ID 75 | 0.00 | 0.00 |
| SEQ ID 76 | 0.00 | 0.21 |
| SEQ ID 77 | 0.32 | 0.33 |
| SEQ ID 78 | 0.00 | 0.17 |
| SEQ ID 79 | 0.00 | 0.17 |
| SEQ ID 80 | 0.00 | 0.16 |
| SEQ ID 81 | 0.00 | 0.13 |
| SEQ ID 82 | 0.00 | 0.28 |
| SEQ ID 83 | 0.18 | 0.00 |
| SEQ ID 84 | 0.00 | 0.00 |
| SEQ ID 85 | 0.00 | 0.00 |
| SEQ ID 86 | 0.00 | 0.20 |
| SEQ ID 87 | 0.00 | 0.00 |

TABLE 3-continued

| % of Xbp1 mRNA with exon 4 skipping of 2 library. | | |
|---|---|---|
| Oligo ID | 5 μM | 25 μM |
| SEQ ID 88 | 0.34 | 0.00 |
| SEQ ID 89 | 0.28 | 0.46 |
| SEQ ID 90 | 0.15 | 0.00 |
| SEQ ID 91 | 0.00 | 0.16 |
| SEQ ID 92 | 0.15 | 0.51 |
| SEQ ID 93 | 0.63 | 0.15 |
| SEQ ID 94 | 1.53 | 1.51 |
| SEQ ID 95 | 0.64 | 2.35 |
| SEQ ID 96 | 0.48 | 2.15 |
| SEQ ID 97 | 1.78 | 4.35 |
| SEQ ID 98 | 0.32 | 0.44 |
| SEQ ID 99 | 3.74 | 3.42 |
| SEQ ID 100 | 1.28 | 1.87 |
| SEQ ID 101 | 5.32 | 7.39 |
| SEQ ID 102 | 2.66 | 4.13 |
| SEQ ID 103 | 10.10 | 13.44 |
| SEQ ID 104 | 6.99 | 11.25 |
| SEQ ID 105 | 1.99 | 4.99 |
| SEQ ID 106 | 1.39 | 1.32 |
| SEQ ID 107 | 0.16 | 1.90 |
| SEQ ID 108 | 0.79 | 1.48 |
| SEQ ID 109 | 0.47 | 0.79 |
| SEQ ID 110 | 1.59 | 1.58 |
| SEQ ID 111 | 1.82 | 1.13 |
| SEQ ID 112 | 0.41 | 0.82 |
| SEQ ID 113 | 0.65 | 0.76 |
| SEQ ID 114 | 0.35 | 0.00 |
| SEQ ID 115 | 0.00 | 0.00 |
| SEQ ID 116 | 0.34 | 0.59 |
| SEQ ID 117 | 0.29 | 0.16 |
| SEQ ID 118 | 0.15 | 0.00 |
| SEQ ID 119 | 0.14 | 0.53 |
| SEQ ID 120 | 0.15 | 0.00 |
| SEQ ID 121 | 0.15 | 0.26 |
| SEQ ID 122 | 0.00 | 0.15 |
| SEQ ID 123 | 0.24 | 0.00 |
| SEQ ID 124 | 0.17 | 0.32 |
| SEQ ID 125 | 0.00 | 0.16 |
| SEQ ID 126 | 0.00 | 0.00 |
| SEQ ID 127 | 0.16 | 0.00 |
| SEQ ID 128 | 0.67 | 1.01 |
| SEQ ID 129 | 0.15 | 0.00 |
| SEQ ID 130 | 0.57 | 0.00 |
| SEQ ID 131 | 0.24 | 0.52 |
| SEQ ID 132 | 0.00 | 0.00 |
| SEQ ID 133 | 0.21 | 0.16 |
| SEQ ID 134 | 0.00 | 0.00 |
| SEQ ID 135 | 0.33 | 0.18 |
| SEQ ID 136 | 0.16 | 0.60 |
| SEQ ID 137 | 0.32 | 0.00 |
| SEQ ID 138 | 0.00 | 0.00 |
| SEQ ID 139 | 0.00 | 0.44 |
| SEQ ID 140 | 1.11 | 0.70 |
| SEQ ID 141 | 0.23 | 1.69 |
| SEQ ID 142 | 0.20 | 1.07 |
| SEQ ID 143 | 1.04 | 0.36 |
| SEQ ID 144 | 0.00 | 0.33 |
| SEQ ID 145 | 0.00 | 0.15 |
| SEQ ID 146 | 0.00 | 0.00 |
| SEQ ID 147 | 0.40 | 1.00 |
| SEQ ID 148 | 1.95 | 3.31 |
| SEQ ID 149 | 6.23 | 11.11 |
| SEQ ID 150 | 1.61 | 2.14 |
| SEQ ID 151 | 0.94 | 1.19 |
| SEQ ID 152 | 0.24 | 0.00 |
| SEQ ID 153 | 0.00 | 0.00 |
| SEQ ID 154 | 0.20 | 0.00 |
| SEQ ID 155 | 0.30 | 0.21 |
| SEQ ID 156 | 0.00 | 0.75 |
| SEQ ID 157 | 0.40 | 0.69 |
| SEQ ID 158 | 0.20 | 1.18 |
| SEQ ID 159 | 0.19 | 0.00 |
| SEQ ID 160 | 0.00 | 0.00 |
| SEQ ID 161 | 0.54 | 0.00 |
| SEQ ID 162 | 0.00 | 0.00 |
| SEQ ID 163 | 0.00 | 0.00 |

TABLE 3-continued

| % of Xbp1 mRNA with exon 4 skipping of 2 library. | | |
|---|---|---|
| Oligo ID | 5 μM | 25 μM |
| SEQ ID 164 | 0.00 | 0.40 |
| SEQ ID 165 | 0.00 | 0.00 |
| SEQ ID 166 | 0.20 | 0.23 |
| SEQ ID 167 | 0.00 | 0.00 |
| SEQ ID 168 | 0.00 | 0.00 |
| SEQ ID 169 | 0.00 | 0.20 |
| SEQ ID 170 | 0.00 | 0.00 |
| SEQ ID 171 | 0.00 | 0.00 |
| SEQ ID 172 | 0.21 | 0.15 |
| SEQ ID 173 | 0.14 | 0.00 |
| SEQ ID 174 | 0.00 | 0.00 |
| SEQ ID 175 | 0.00 | 0.00 |
| SEQ ID 176 | 0.16 | 0.00 |
| SEQ ID 177 | 0.00 | 0.00 |
| SEQ ID 178 | 0.00 | 0.15 |
| SEQ ID 179 | 0.00 | 0.00 |
| SEQ ID 180 | 0.00 | 0.13 |
| SEQ ID 181 | 0.14 | 0.15 |
| SEQ ID 182 | 0.25 | 0.40 |
| SEQ ID 183 | 0.00 | 0.28 |
| SEQ ID 184 | 0.00 | 0.00 |
| SEQ ID 185 | 0.00 | 0.15 |
| SEQ ID 186 | 0.00 | 0.00 |
| SEQ ID 187 | 0.00 | 0.00 |
| SEQ ID 188 | 0.00 | 0.00 |
| SEQ ID 189 | 0.00 | 0.13 |
| SEQ ID 190 | 0.14 | 0.00 |
| SEQ ID 191 | 0.13 | 0.35 |
| SEQ ID 192 | 0.00 | 0.00 |
| SEQ ID 193 | 0.51 | 1.29 |
| SEQ ID 194 | 1.53 | 1.35 |
| SEQ ID 195 | 1.37 | 3.95 |
| SEQ ID 196 | 1.69 | 2.48 |
| SEQ ID 197 | 1.05 | 1.74 |
| SEQ ID 198 | 0.80 | 1.51 |
| SEQ ID 199 | 1.53 | 2.59 |
| SEQ ID 200 | 1.94 | 2.52 |
| SEQ ID 201 | 3.77 | 5.27 |
| SEQ ID 202 | 2.87 | 2.98 |
| SEQ ID 203 | 1.46 | 1.52 |
| SEQ ID 204 | 0.65 | 1.87 |
| SEQ ID 205 | 2.37 | 4.44 |
| SEQ ID 206 | 2.57 | 5.31 |
| SEQ ID 207 | 2.99 | 5.41 |
| SEQ ID 208 | 3.89 | 8.39 |
| SEQ ID 209 | 7.75 | 13.36 |
| SEQ ID 210 | 7.69 | 11.34 |
| SEQ ID 211 | 7.07 | 8.04 |
| SEQ ID 212 | 4.27 | 0.41 |
| SEQ ID 213 | 0.20 | 0.17 |
| SEQ ID 214 | 2.16 | 2.25 |
| SEQ ID 215 | 1.67 | 2.89 |
| SEQ ID 216 | 1.49 | 1.64 |
| SEQ ID 217 | 2.32 | 0.00 |
| SEQ ID 218 | 0.62 | 1.36 |
| SEQ ID 219 | 1.27 | 0.20 |
| SEQ ID 220 | 1.02 | 3.76 |
| SEQ ID 221 | 1.67 | 4.62 |
| SEQ ID 222 | 2.76 | 6.39 |
| SEQ ID 223 | 0.53 | 0.97 |
| SEQ ID 224 | 0.47 | 1.48 |
| SEQ ID 225 | 0.00 | 0.00 |
| SEQ ID 226 | 0.52 | 1.37 |
| SEQ ID 227 | 0.22 | 0.00 |
| SEQ ID 228 | 0.69 | 0.33 |
| SEQ ID 229 | 1.47 | 0.71 |
| SEQ ID 230 | 0.63 | 0.96 |
| SEQ ID 231 | 0.00 | 0.00 |
| SEQ ID 232 | 0.64 | 0.00 |
| SEQ ID 233 | 0.24 | 0.83 |
| SEQ ID 234 | 0.22 | 0.00 |
| SEQ ID 235 | 0.54 | 0.44 |
| SEQ ID 236 | 0.00 | 0.00 |
| SEQ ID 237 | 0.00 | 0.22 |
| SEQ ID 238 | 0.00 | 0.00 |
| SEQ ID 239 | 0.34 | 0.00 |

TABLE 3-continued

| % of Xbp1 mRNA with exon 4 skipping of 2 library. | | |
|---|---|---|
| Oligo ID | 5 μM | 25 μM |
| SEQ ID 240 | 0.00 | 0.00 |
| SEQ ID 241 | 0.00 | 0.00 |
| SEQ ID 242 | 0.66 | 0.42 |
| SEQ ID 243 | 0.18 | 0.00 |
| SEQ ID 244 | 0.00 | 0.00 |
| SEQ ID 245 | 0.00 | 0.17 |
| SEQ ID 246 | 0.00 | 0.71 |
| SEQ ID 247 | 0.00 | 0.00 |
| SEQ ID 248 | 0.18 | 0.20 |
| SEQ ID 249 | 0.00 | 0.22 |
| SEQ ID 250 | 0.00 | 0.00 |
| SEQ ID 251 | 0.00 | 0.00 |
| SEQ ID 252 | 0.39 | 0.45 |
| SEQ ID 253 | 0.53 | 0.19 |
| SEQ ID 254 | 0.00 | 0.00 |
| SEQ ID 255 | 0.18 | 0.21 |
| SEQ ID 256 | 0.17 | 0.36 |
| SEQ ID 257 | 0.00 | 0.00 |
| SEQ ID 258 | 0.00 | 0.34 |
| SEQ ID 259 | 0.37 | 0.97 |
| SEQ ID 260 | 0.33 | 0.86 |
| SEQ ID 261 | 0.36 | 0.22 |
| SEQ ID 262 | 0.00 | 0.17 |
| SEQ ID 263 | 0.17 | 0.15 |
| SEQ ID 264 | 0.00 | 0.00 |
| SEQ ID 265 | 0.35 | 0.00 |
| SEQ ID 266 | 0.16 | 0.00 |
| SEQ ID 267 | 0.00 | 0.00 |
| SEQ ID 268 | 0.49 | 0.53 |
| SEQ ID 269 | 0.00 | 0.00 |
| SEQ ID 270 | 0.00 | 0.20 |
| SEQ ID 271 | 0.00 | 0.15 |
| SEQ ID 272 | 0.20 | 0.17 |
| SEQ ID 273 | 0.29 | 0.00 |
| SEQ ID 274 | 0.40 | 0.49 |
| SEQ ID 275 | 0.20 | 0.17 |
| SEQ ID 276 | 0.14 | 0.00 |
| SEQ ID 277 | 0.00 | 0.00 |
| SEQ ID 278 | 0.00 | 0.19 |
| SEQ ID 279 | 0.16 | 0.17 |
| SEQ ID 280 | 0.18 | 0.17 |
| SEQ ID 281 | 0.00 | 1.90 |
| SEQ ID 282 | 0.59 | 1.75 |
| SEQ ID 283 | 0.15 | 0.38 |
| SEQ ID 284 | 0.15 | 0.53 |
| SEQ ID 285 | 2.63 | 5.34 |
| SEQ ID 286 | 0.60 | 2.62 |
| SEQ ID 287 | 0.33 | 0.51 |
| SEQ ID 288 | 0.35 | 0.43 |
| SEQ ID 289 | 0.19 | 0.53 |
| SEQ ID 290 | 0.00 | 0.00 |
| SEQ ID 291 | 0.20 | 0.37 |
| SEQ ID 292 | 0.39 | 0.00 |
| SEQ ID 293 | 0.00 | 0.00 |
| SEQ ID 294 | 0.28 | 0.31 |
| SEQ ID 295 | 0.00 | 0.09 |
| SEQ ID 296 | 0.14 | 0.45 |
| SEQ ID 297 | 1.93 | 1.52 |
| SEQ ID 298 | 0.98 | 1.77 |

Example 3-Identification of ASO to Induce Splice Skipping of Exon in the Mouse XBP1 mRNA, to Make a XBP1 Protein Mimic that Works Similarly to the Naturally Processed XBP1 Protein Ltk-11 (ATCC® CRL-10422™) cells were obtained from the ATCC cell bank, and were grown and maintained according to ATCC guidelines. 102 ASOs complementary to a region around exon 4 of the XBP1 mRNA NM_013842.3 (SeqID 2) were tested for the ability to induce exon skipping of exon 4.

2000 cells LTK cells were seeded in a 96 well plate, 24 hours later the ASOs were added directly to the cell medium at a final concentration of 5 μM and 25 μM. Cells were harvested after 3 days and total RNA was isolated using the the RNeasy 96 well kit from Qiagen according to manufactures instructions.

cDNA was generated using the iScript™ Advanced cDNA Synthesis Kit for RT-qPCR from. Biorad. Relative mRNA expression was measured by droplet digital PCR using the QX200 ddPCR system from Biorad along with the automated droplet generator AutoDG from Biorad. PCR was performed using the ddPCR supermix for probes (no UTP) from biorad according to manufactories instructions.

The following primers and probes were used to measure the amount of mRNAs with exon skipping of exon4 (XBP1 delta 4 assay) and the amount of mRNA with normal joining of exon 4 and 5 (XBP1 WT) both purchased from IDT technologies. The XBP1 WT assay detected both the IRE-1 processed and unprocessed mRNA.

```
XBP1 WT assay:
                                        (SEQ ID NO: 1503)
Primer 2 (AGG GTC CAA CTT GTC C)

                                        (SEQ ID NO: 1504)
Primer 1 (CTG GAT CCT GAC GAG GTT C)

                                        (SEQ ID NO: 1505)
Probe /5HEX/CTT ACT CCA /ZEN/CTC CCC TTG GCC TCC
A/3IABkFQ/

XBP1 delta 4 assay:
                                        (SEQ ID NO: 1503)
Primer 2 (AGG GTC CAA CTT GTC C)

                                        (SEQ ID NO: 1504)
Primer 1 (CTG GAT CCT GAC GAG GTT C)

                                        (SEQ ID NO: 1506)
/56-FAM/CCC AAA AGG /ZEN/ATA TCA GAC TTG GCC TCC
A/3IABkFQ/
```

Data was analyzed using the QuantaSoft™ Analysis Pro software from Biorad. The percentile of mRNAs containing skipping of exon 4, was calculated by (conc delta 4/(conc delta 4+concWT))*100. The normal percentile of mRNA with exon 4 skipping was calculated from the average of 61 control wells treated with PBS only. The average of PBS wells were 0.37% with a standard deviation of 0.17. The data is shown in Table 4.

TABLE 4

| % of XBP1 exon 4 splice skipping | | |
|---|---|---|
| | 10 μM | 25 μM |
| SEQ ID 597 | 1.80 | 3.24 |
| SEQ ID 598 | 0.76 | 1.93 |
| SEQ ID 599 | 0.40 | 0.86 |
| SEQ ID 600 | 0.06 | 0.33 |
| SEQ ID 601 | 2.61 | 3.56 |
| SEQ ID 602 | 0.30 | 0.18 |
| SEQ ID 603 | 0.43 | 0.71 |
| SEQ ID 604 | 0.58 | 0.52 |
| SEQ ID 605 | 0.27 | 0.54 |
| SEQ ID 606 | 0.31 | 0.37 |
| SEQ ID 607 | 0.39 | 0.28 |
| SEQ ID 608 | 5.17 | 8.88 |
| SEQ ID 609 | 0.67 | 0.54 |
| SEQ ID 610 | 0.27 | 0.52 |
| SEQ ID 611 | 1.03 | 1.01 |
| SEQ ID 612 | 0.00 | 0.68 |
| SEQ ID 613 | 0.57 | 0.62 |
| SEQ ID 614 | 0.22 | 0.00 |
| SEQ ID 615 | 0.26 | 0.22 |

TABLE 4-continued

| % of XBP1 exon 4 splice skipping | | |
|---|---|---|
| | 10 μM | 25 μM |
| SEQ ID 616 | 0.53 | 0.27 |
| SEQ ID 617 | 0.48 | 0.09 |
| SEQ ID 618 | 0.90 | 0.71 |
| SEQ ID 619 | 0.38 | 0.16 |
| SEQ ID 620 | 0.60 | 0.70 |
| SEQ ID 621 | 0.59 | 0.24 |
| SEQ ID 622 | 1.01 | 0.65 |
| SEQ ID 623 | 0.22 | 0.30 |
| SEQ ID 624 | 0.31 | 0.71 |
| SEQ ID 625 | 0.34 | 0.60 |
| SEQ ID 626 | 0.35 | 0.53 |
| SEQ ID 627 | 0.74 | 1.03 |
| SEQ ID 628 | 0.49 | 0.12 |
| SEQ ID 629 | 0.24 | 0.12 |
| SEQ ID 630 | 0.39 | 0.25 |
| SEQ ID 631 | 0.25 | 0.22 |
| SEQ ID 632 | 0.15 | 0.08 |
| SEQ ID 633 | 0.31 | 0.26 |
| SEQ ID 634 | 0.58 | 0.76 |
| SEQ ID 635 | 0.07 | 0.19 |
| SEQ ID 636 | 0.25 | 0.14 |
| SEQ ID 637 | 0.74 | 1.76 |
| SEQ ID 638 | 0.84 | 0.56 |
| SEQ ID 639 | 0.66 | 1.17 |
| SEQ ID 640 | 0.51 | 0.75 |
| SEQ ID 641 | 0.97 | 1.82 |
| SEQ ID 642 | 0.14 | 1.35 |
| SEQ ID 643 | 2.56 | 3.91 |
| SEQ ID 644 | 0.86 | 0.86 |
| SEQ ID 645 | 0.67 | 0.14 |
| SEQ ID 646 | 0.76 | 0.98 |
| SEQ ID 647 | 0.68 | 1.00 |
| SEQ ID 648 | 2.42 | 3.24 |
| SEQ ID 649 | 1.86 | 3.57 |
| SEQ ID 650 | 0.69 | 1.51 |
| SEQ ID 651 | 1.84 | 3.76 |
| SEQ ID 652 | 2.34 | 5.95 |
| SEQ ID 653 | 1.97 | 3.85 |
| SEQ ID 654 | 3.86 | 9.13 |
| SEQ ID 655 | 11.01 | 19.67 |
| SEQ ID 656 | 5.56 | 10.31 |
| SEQ ID 657 | 4.77 | 7.55 |
| SEQ ID 658 | 6.59 | 10.15 |
| SEQ ID 659 | 1.59 | 4.31 |
| SEQ ID 660 | 1.78 | 3.20 |
| SEQ ID 661 | 1.57 | 3.49 |
| SEQ ID 662 | 0.73 | 0.36 |
| SEQ ID 663 | 0.58 | 0.91 |
| SEQ ID 664 | 0.25 | 0.79 |
| SEQ ID 665 | 0.19 | 0.19 |
| SEQ ID 666 | 0.30 | 0.63 |
| SEQ ID 667 | 0.27 | 0.29 |
| SEQ ID 668 | 0.82 | 0.00 |
| SEQ ID 669 | 0.76 | 0.50 |
| SEQ ID 670 | 0.27 | 0.90 |
| SEQ ID 671 | 1.04 | 0.84 |
| SEQ ID 672 | 0.89 | 0.63 |
| SEQ ID 673 | 0.72 | 0.23 |
| SEQ ID 674 | 0.89 | 1.46 |
| SEQ ID 675 | 0.84 | 0.80 |
| SEQ ID 676 | 2.28 | 3.83 |
| SEQ ID 677 | 0.28 | 0.23 |
| SEQ ID 678 | 0.28 | 0.25 |
| SEQ ID 679 | 2.24 | 4.35 |
| SEQ ID 680 | 0.28 | 0.43 |
| SEQ ID 681 | 1.15 | 2.02 |
| SEQ ID 682 | 1.59 | 2.60 |
| SEQ ID 683 | 1.76 | 2.90 |
| SEQ ID 684 | 0.58 | 0.44 |
| SEQ ID 685 | 0.65 | 1.36 |
| SEQ ID 686 | 0.42 | 0.35 |
| SEQ ID 687 | 0.76 | 1.26 |
| SEQ ID 688 | 2.28 | 4.48 |
| SEQ ID 689 | 2.46 | 7.24 |
| SEQ ID 690 | 5.48 | 10.93 |
| SEQ ID 691 | 2.82 | 4.68 |
| SEQ ID 692 | 3.48 | 6.20 |
| SEQ ID 693 | 2.76 | 5.11 |
| SEQ ID 694 | 1.15 | 2.20 |
| SEQ ID 695 | 4.86 | 6.35 |
| SEQ ID 696 | 1.02 | 2.34 |
| SEQ ID 697 | 3.20 | 4.73 |
| SEQ ID 698 | 0.96 | 1.17 |

Example 4: Identification of ASO to Induce Splice Skipping of Exon in the Human XBP1 mRNA, to Make a XBP1 Protein Mimic that Works Similarly to the Naturally Processed XBP1 Protein A459 cells were obtained from the ATCC cell bank, and were grown and maintained according to ATCC guidelines. 100 ASOs complementary to a region around exon 4 of the XBP1 mRNA NM_005080.4 (SeqID 2) were tested for the ability to induce exon skipping of exon 4.

4000 A549 cells were seeded in a 96 well plate, 24 hours later the ASOs were added directly to the cell medium at a final concentration of 25 μM. Cells were harvested after 3 days and total RNA was isolated using the the RNeasy 96 well kit from Qiagen according to manufactures instructions.

cDNA was generated using the iScript™ Advanced cDNA Synthesis Kit for RT-qPCR from Biorad. Relative mRNA expression was measured by droplet digital PCR using the QX200 ddPCR system from Biorad along with the automated droplet generator AutoDG from Biorad. PCR was performed using the ddPCR supermix for probes (no UTP) from biorad according to manufactories instructions.

The following primers and probes were used to measure the amount of mRNAs with exon skipping of exon4 (XBP1A assay) and the amount of mRNA with normal joining of exon 4 and 5 (XBP1 WT) both purchased from IDT technologies. The XBP1 WT assay detected both the IRE-1 processed and unprocessed mRNA.

```
XBP1WT assay:
                                        (SEQ ID NO: 1503)
Primer 2 (CTG GGT CCA AGT TGT CCA GA)

                                        (SEQ ID NO: 1504)
Primer 1 (ATG CCC TGG TTG CTG AAG)

                                        (SEQ ID NO: 1505)
Probe /5HEX/TCA CTT CAT /ZEN/TCC CCT TGG CTT CCG
C/3IABkFQ/

XBP1Δ4 assay:
                                        (SEQ ID NO: 1503)
Primer 2 (CTG GGT CCA AGT TGT CCA GA)

                                        (SEQ ID NO: 1504)
Primer 1 (ATG CCC TGG TTG CTG AAG)

                                        (SEQ ID NO: 1506)
/56-FAM/CCA ACA GGA /ZEN/TAT CAG ACT TGG CTT CCG
C/3IABkFQ/
```

Data was analyzed using the QuantaSoft™ Analysis Pro software from Biorad. The percentile of mRNAs containing skipping of exon 4, was calculated by (concΔ4/(concΔ4+concWT))*100. The normal percentile of mRNA with exon 4 skipping was calculated from the average of 40 control wells treated with PBS only. The average of PBS wells was 0.03% with a standard deviation of 0.05. The data is shown in Table 5.

TABLE 5

| % of XBP1 exon4 skipping | |
|---|---|
| Oligo used | % of XBP1 exon4 splice skipping |
| SEQ ID 808 | 0.00 |
| SEQ ID 809 | 0.12 |
| SEQ ID 810 | 0.00 |
| SEQ ID 811 | 0.00 |
| SEQ ID 812 | 0.13 |
| SEQ ID 813 | 0.07 |
| SEQ ID 814 | 0.05 |
| SEQ ID 815 | 0.00 |
| SEQ ID 816 | 0.00 |
| SEQ ID 817 | 0.00 |
| SEQ ID 818 | 0.11 |
| SEQ ID 819 | 0.00 |
| SEQ ID 820 | 0.06 |
| SEQ ID 821 | 0.08 |
| SEQ ID 822 | 0.11 |
| SEQ ID 823 | 0.00 |
| SEQ ID 824 | 0.11 |
| SEQ ID 825 | 0.00 |
| SEQ ID 826 | 0.06 |
| SEQ ID 827 | 0.00 |
| SEQ ID 828 | 0.00 |
| SEQ ID 829 | 0.00 |
| SEQ ID 830 | 0.00 |
| SEQ ID 831 | 0.08 |
| SEQ ID 832 | 0.00 |
| SEQ ID 833 | 0.07 |
| SEQ ID 834 | 0.12 |
| SEQ ID 835 | 0.00 |
| SEQ ID 836 | 0.18 |
| SEQ ID 837 | 0.00 |
| SEQ ID 838 | 0.00 |
| SEQ ID 839 | 0.00 |
| SEQ ID 840 | 0.07 |
| SEQ ID 841 | 0.00 |
| SEQ ID 842 | 0.19 |
| SEQ ID 843 | 0.68 |
| SEQ ID 844 | 0.91 |
| SEQ ID 845 | 0.67 |
| SEQ ID 846 | 0.85 |
| SEQ ID 847 | 0.31 |
| SEQ ID 848 | 0.25 |
| SEQ ID 849 | 0.28 |
| SEQ ID 850 | 0.35 |
| SEQ ID 851 | 0.35 |
| SEQ ID 852 | 0.47 |
| SEQ ID 853 | 0.30 |
| SEQ ID 854 | 1.67 |
| SEQ ID 855 | 1.99 |
| SEQ ID 856 | 2.93 |
| SEQ ID 857 | 2.29 |
| SEQ ID 858 | 6.67 |
| SEQ ID 859 | 0.49 |
| SEQ ID 860 | 0.00 |
| SEQ ID 861 | 0.00 |
| SEQ ID 862 | 0.27 |
| SEQ ID 863 | 0.19 |
| SEQ ID 864 | 0.00 |
| SEQ ID 865 | 0.00 |
| SEQ ID 866 | 0.00 |
| SEQ ID 867 | 0.20 |
| SEQ ID 868 | 0.00 |
| SEQ ID 869 | 0.00 |
| SEQ ID 870 | 0.00 |
| SEQ ID 871 | 0.00 |
| SEQ ID 872 | 0.00 |
| SEQ ID 873 | 0.00 |
| SEQ ID 874 | 0.21 |
| SEQ ID 875 | 0.00 |
| SEQ ID 876 | 0.07 |
| SEQ ID 877 | 0.00 |
| SEQ ID 878 | 0.06 |

TABLE 5-continued

| % of XBP1 exon4 skipping | |
|---|---|
| Oligo used | % of XBP1 exon4 splice skipping |
| SEQ ID 879 | 0.13 |
| SEQ ID 880 | 0.09 |
| SEQ ID 881 | 0.09 |
| SEQ ID 882 | 0.06 |
| SEQ ID 883 | 0.14 |
| SEQ ID 884 | 0.00 |
| SEQ ID 885 | 0.08 |
| SEQ ID 886 | 0.25 |
| SEQ ID 887 | 0.11 |
| SEQ ID 888 | 0.25 |
| SEQ ID 889 | 0.47 |
| SEQ ID 890 | 0.08 |
| SEQ ID 891 | 0.58 |
| SEQ ID 892 | 0.60 |
| SEQ ID 893 | 0.25 |
| SEQ ID 894 | 0.69 |
| SEQ ID 895 | 1.52 |
| SEQ ID 896 | 0.07 |
| SEQ ID 897 | 0.55 |
| SEQ ID 898 | 0.14 |
| SEQ ID 899 | 0.41 |
| SEQ ID 900 | 0.25 |

Example 5: Plasmid Generation for Targeted Integration

In general, to construct the plasmids for RMCE, the respective expression cassettes for the antibody light chain and heavy chain were cloned into a first vector backbone flanked by L3 and LoxFas sequences, and a second vector flanked by LoxFas and 2L sequences and also further including a selectable marker. A Cre recombinase plasmid (see, e.g., Wong, E. T., et al., Nucl. Acids Res. 33 (2005) e147; O'Gorman, S., et al., Proc. Natl. Acad. Sci. USA 94 (1997) 14602-14607) was used for all RMCE processes.

The cDNAs encoding the respective polypeptides were generated by gene synthesis (Geneart, Life Technologies Inc.). The synthesized cDNAs and backbone-vectors were digested with HindIII-HF and EcoRI-HF (NEB) at 37° C. for 1 h and separated by agarose gel electrophoresis. The bands comprising the DNA-fragment of the insert and backbone, respectively, were cut out from the agarose gel and extracted by QIAquick Gel Extraction Kit (Qiagen). The purified insert and backbone fragment was ligated via the Rapid Ligation Kit (Roche Diagnostics GmbH, Mannheim, Germany) following the manufacturer's protocol with an Insert/Backbone ratio of 3:1. The ligation approach was then transformed into competent *E. coli* DH5a via heat shock and incubated for 1 h at 37° C. Thereafter the cells were plated out on agar plates with ampicillin for selection. Plates were incubated at 37° C. overnight.

On the following day clones were picked and incubated overnight at 37° C. under shaking for the Mini or Maxi-Preparation, which was performed with the EpMotion® 5075 (Eppendorf) or with the QIAprep Spin Mini-Prep Kit (Qiagen)/NucleoBond Xtra Maxi EF Kit (Macherey & Nagel), respectively. All constructs were sequenced to ensure correctness of the sequences.

In the second cloning step, the generated vectors were digested with KpnI-HF/SalI-HF and SalI-HF/MfeI-HF with the same conditions as outlined above. The respective RMCE (TI) backbone vector was digested with KpnI-HF and MfeI-HF. Separation and extraction was performed as described above. Ligation of the purified insert and backbone was performed using T4 DNA Ligase (NEB) following the manufacturer's protocol with an Insert/Insert/Backbone ratio of 1:1:1 overnight at 4° C. Thereafter ligase was inactivated at 65° C. for 10 min. The following steps were performed as described above.

Example 6: Generation of Stable Cell Lines by Targeted Integration

CHO TI host cells comprising a GFP expression cassette in the TI landing site were propagated in disposable 125 ml vented shake flasks under standard humidified conditions (95% rH, 37° C., and 5% $CO_2$) at a constant agitation rate of 150 rpm in a DMEM/F12-based medium. Every 3-4 days the cells were seeded with a concentration of 3×10E5 cells/ml in chemically defined medium containing selection marker 1 and selection marker 2 in effective concentrations. Density and viability of the cultures were measured with a Cedex HiRes cell counter (F. Hoffmann-La Roche Ltd, Basel, Switzerland).

For stable transfection, equimolar amounts of first and second vector generated according to Example 5 were mixed. 1 µg Cre encoding nucleic acid was added per 5 µg of the mixture, i.e. 5 µg Cre expression plasmid or Cre mRNA was added to 25 µg of the vector mixture.

Two days prior to transfection TI host cells were seeded in fresh medium with a density of about 4×10E5 cells/ml. Transfection was performed with the Nucleofector device using the Nucleofector Kit V (Lonza, Switzerland), according to the manufacturer's protocol. 3×10E7 cells were transfected with a total of 30 µg nucleic acid mixture, i.e. with 30 µg plasmid (5 µg Cre plasmid and 25 µg vector mixture). After transfection, the cells were seeded in 30 ml medium without selection agents.

On day 5 after seeding the cells were centrifuged and transferred at a cell density of 6×10E5 cells/ml to 80 mL chemically defined medium containing selection agent 1 and selection agent 2 at effective concentrations for selection of recombinant cells. The cells were incubated at 37° C., 150 rpm, 5% $CO_2$, and 85% humidity from this day on without splitting. Cell density and viability of the culture was monitored regularly. When the viability of the culture started to increase again, the concentrations of selection agents 1 and 2 were reduced to about half the amount used before. In more detail, to promote the recovering of the cells, the selection pressure was reduced if the viability is >40% and the viable cell density (VCD) is >0.5×10E6 cells/mL. Therefore, 4×10E5 cells/ml were centrifuged and re-suspended in 40 ml selection media II (chemically-defined medium, 1/2 selection marker 1 & 2). The cells were incubated with the same conditions as before and also not splitted.

Ten days after starting selection, the success of RMCE was checked by flow cytometry measuring the expression of intracellular GFP and extracellular heterologous polypeptide sticking to the cell surface. An APC antibody (allophycocyanin-labeled F(ab')2 Fragment goat anti-human IgG) against human antibody light and heavy chain was used for FACS staining. Flow cytometry was performed with a BD FACS Canto II flow cytometer (BD, Heidelberg, Germany). Ten thousand events per sample were measured. Living cells were gated in a plot of forward scatter (FSC) against side scatter (SSC). The live cell gate was defined with non-transfected TI host cells and applied to all samples by employing the FlowJo™ 7.6.5 EN software (TreeStar, Olten, Switzerland). Fluorescence of GFP was quantified in the FITC channel (excitation at 488 nm, detection at 530 nm). Antibody was measured in the APC channel (excitation at 645 nm, detection at 660 nm). Parental CHO cells, i.e. those cells used for the generation of the TI host cell, were used as a negative control with regard to GFP and antibody expression. Fourteen days after the selection had been started, the viability exceeded 90% and selection was considered as complete.

Example 7: FACS Screening

FACS analysis was performed to check the transfection and RMCE efficiency. 4×10E5 cells of the transfected approaches were centrifuged (1200 rpm, 4 min.) and washed twice with 1 mL PBS. After the washing steps with PBS the pellet was re-suspended in 400 µL PBS and transferred into FACS tubes (Falcon® Round-Bottom Tubes with cell strainer cap; Corning). The measurement was performed with a FACS Canto II and the data were analyzed by the software FlowJo™.

Example 8: Fed-Batch Cultivation with LNA Addition

All fed-batch cultures were performed in shake flasks or Ambr®15 vessels (Sartorius Stedim) with the same proprietary serum-free, chemically defined medium and under the same cultivation and feeding conditions.

The recombinant mammalian cells used in this example were obtained according to the procedure described in Example 6 and expressed a heterologous antibody (Protein 1: antibody-multimer-fusion).

The cell culture process consisted of a seed train cultivation, followed with inoculation train (N-2 and N-1 cultures; pre-fermentation) and main fermentation (N). The seed-and inoculation train for the Ambr®15 was performed in shake flasks with cell splits every 3 or 4 days.

The antisense oligonucleotides of SEQ ID NO 23 and SEQ ID NO 24 were chosen as the LNAs due to the high level of exon 4 skipping observed with these antisense oligonucleotides in initial studies (see Example 1).

The (main) cultivations (N) in Ambr®15 were performed with a starting cell density of about 2*10E6 cells/ml in a total volume of 13 ml. The cultivation temperature was controlled, the N2 gassing rate was set constant, oxygen supply was regulated via a PID controller to maintain a constant DO, the agitation rate was set to 1200-1400 rpm (down stirring), the pH was set to pH 7.0. The pH-control was performed by adding a 1 M sodium carbonate solution or sparging $CO_2$ into the bioreactor. The pH spots of the bioreactors were recalibrated every other day with the integrated analysis module of the Ambr®15. Defoamer was added one day before inoculation and daily during the cultivation. The cells were cultivated in a 14 days fed batch process with glucose control and two different feeds, which were added as bolus at predefined time points. The cell count and viability measurements were performed at-line with a Cedex HiRes (Roche Diagnostics GmbH, Mannheim, Germany). A Cedex Bio HT Analyzer (Roche Diagnostics GmbH) was used to measure product and metabolite concentrations.

The LNA addition at the beginning of the N-1 pre-cultivation (N-1), inoculation day (d0) or three days after the inoculation (d3) were performed by the liquid handling system of the Ambr@15 by adding a defined volume of a high concentrated LNA stock solution.

The supernatant was harvested 14 days after start of fed-batch by centrifugation (10 min, 1000 rpm and 10 min, 4000 rpm) and cleared by filtration (0.22 µm). Day 14 titers were determined using protein A affinity chromatography with UV detection. Product quality was determined by Caliper's LabChip® (Caliper Life Sciences).

It appears as though any efficiency in exon4 skipping of the LNA is sufficient to generate the effect of increased recombinant titer.

TABLE 6

Result of the 14-day fed-batch cultivation in Ambr ®15; N-1 = LNA-addition at the start of the pre-fermentation; d0 = LNA addition at day 0, i.e. start of the main fermentation; d3 = LNA-addition at day 3 of the main fermentation.

| exp. | SEQ ID | add LNA timing at | titer [mg/L] | eff. titer | rel. eff titer | average rel. eff titer |
|---|---|---|---|---|---|---|
| 1 | no | — | 2300 | 1218.8 | 100% | 100 |
| 2 | 23 | N-1 & d 0 | 2676 | 1554.5 | 128% | 119% |
| 3 | 23 | N-1 & d 0 | 2477 | 1353.6 | 111% | |
| 4 | 23 | d 3 | 2335 | 1222.5 | 100% | 102% |
| 5 | 23 | d 3 | 2356 | 1261.1 | 103% | |
| 6 | 24 | N-1 | 2444 | 1330.1 | 109% | 117% |
| 7 | 24 | N-1 | 2670 | 1523.0 | 125% | |
| 8 | 24 | d 3 | 2316 | 1295.8 | 106% | 103% |
| 9 | 24 | d 3 | 2304 | 1223.9 | 100% | |

Example 9: Fed-Batch Cultivation with Stable XBP1Δ4 Expression-Comparative Example All fed-batch cultures were performed in shake flasks or Ambr®15 vessels (Sartorius Stedim) with the same proprietary serum free, chemically defined medium.

The cell culture process consisted of a seed train cultivation, followed with inoculation train (N-2 and N-1 cultures; pre-fermentation) and main fermentation (N). The seed-and inoculation train for the Ambr@15 was performed in shake flasks with cell splits every 3 or 4 days.

The recombinant mammalian cells used in this example were obtained according to the procedure described in Example 6 and stably expressed a heterologous antibody as well as XBP1 splice variant XBP1Δ4 with an amino acid sequences as depicted in SEQ ID NO: 7.

The (main) cultivations (N) in Ambr@15 were performed with a starting cell density of about 2*10E6 cells/ml in a total volume of 13 ml. The cultivation temperature was controlled, the N2 gassing rate was set constant, oxygen supply was regulated via a PID controller to maintain a constant DO, the agitation rate was set to 1200-1400 rpm (down stirring), the pH was set to pH 7.0. The pH-control was performed by adding a 1 M sodium carbonate solution or sparging $CO_2$ into the bioreactor. The pH spots of the bioreactors were recalibrated every other day with the integrated analysis module of the Ambr®15. Defoamer was added one day before inoculation and daily during the cultivation. The cells were cultivated in a 14 days fed batch process with glucose control and two different feeds, which were added as bolus at predefined time points. The cell count and viability measurements were performed at-line with a Cedex HiRes (Roche Diagnostics GmbH, Mannheim, Germany). A Cedex Bio HT Analyzer (Roche Diagnostics GmbH) was used to measure product and metabolite concentrations.

The supernatant was harvested 14 days after start of fed-batch by centrifugation (10 min, 1000 rpm and 10 min, 4000 rpm) and cleared by filtration (0.22 μm). Day 14 titers were determined using protein A affinity chromatography with UV detection. Product quality was determined by Caliper's LabChip® (Caliper Life Sciences).

TABLE 7

Result of the 14-day fed-batch cultivation in Ambr ®15 of recombinant mammalian CHO cell stably transfected with antibody (Protein 1: antibody-multimer-fusion) and XBP1Δ4 variant encoding nucleic acids. exp. = experiment number, eff. titer = effective titer (product of titer and main peak as determined by capillary electrophoresis or SEC), rel, eff. titer = relative effective titer (relative titer normalized to exp. 1).

| exp. | extra factor | titer [mg/L] | eff. titer | rel. eff titer | average rel. eff titer |
|---|---|---|---|---|---|
| 1 | — | 2300 | 1218.8 | 100% | 100 |
| 2 | XBP1Δ4 variant | 1135 | 414.7 | 34% | 38.5% |
| 3 | XBP1Δ4 variant | 969 | 523.8 | 43% | |

Example 10: Fed-Batch Cultivation with LNA Addition

The same conditions for the fed-batch cultivation as described in Example 8 above were also used herein. The only difference of the current Example 10 to Example 8 is with respect to the expressed protein and the addition time of the LNA.

Likewise, the recombinant CHO cells used in this Example were obtained with the method according to Example 6.

Protein 1: Antibody-Multimer-Fusion

TABLE 8

Data for pool:

| exp. | SEQ ID | add LNA timing at | titer [mg/L] | rel. eff titer |
|---|---|---|---|---|
| 1 | no | — | 899 | 100% |
| 2 | 23 | N-1 & d0 | 1185 | 131.9% |
| 3 | 23 | d0 | 1078 | 119.9% |
| 4 | 23 | d0 & d3 | 1106 | 123.1% |
| 5 | 23 | d3 | 1142 | 127% |

TABLE 9

Data for single clone:

| exp. | SEQ ID | add LNA timing at | titer [mg/L] | rel. eff titer |
|---|---|---|---|---|
| 1 | no | — | 2468 | 100% |
| 2 | 23 | N-1 & d0 | 3375 | 136.8% |
| 3 | 23 | d0 | 3049 | 123.6% |
| 4 | 23 | d0 & d3 | 3041 | 123.2% |
| 5 | 23 | d3 | 3285 | 133.1% |
| 6 | 24 | N-1 & d0 | 3371 | 136.6% |
| 7 | 24 | d0 & d3 | 2522 | 102.2% |
| 8 | 24 | d3 | 2914 | 118.1% |

Protein 2: bispecific, trivalent antibody comprising a full-length antibody binding to human A-beta protein and additional heavy chain C-terminal Fab fragment with domain exchange binding to human transferrin receptor (see WO 2017/055540)

TABLE 10

| Data for single clone: | | | | |
|---|---|---|---|---|
| exp. | SEQ ID | add LNA timing at | titer [mg/L] | rel. eff titer |
| 1 | no | — | 1312 | 100% |
| 2 | 23 | N-1 & d0 | 1522 | 116.0% |
| 3 | 23 | d0 | 1533 | 116.9% |
| 4 | 23 | d0 & d3 | 1433 | 109.3% |
| 5 | 23 | d3 | 1572 | 119.8% |
| 6 | 24 | N-1 & d0 | 1497 | 114.1% |
| 7 | 24 | d0 | 1554 | 118.4% |
| 8 | 24 | d0 & d3 | 1484 | 113.1% |
| 9 | 24 | d3 | 1434 | 109.3% |

Protein 3: Tetravalent, Bispecific Antibody with Domain Exchange

TABLE 11

| Data for single clone: | | | | |
|---|---|---|---|---|
| exp. | SEQ ID | add LNA timing at | titer [mg/L] | rel. eff titer |
| 1 | no | — | 1339 | 100% |
| 2 | 23 | N-1 & d0 | 1434 | 107.1% |
| 3 | 23 | d0 | 1518 | 113.3% |
| 4 | 23 | d0 & d3 | 1431 | 106.8% |
| 5 | 23 | d3 | 1509 | 112.7% |
| 6 | 24 | N-1 & d0 | 1241 | 92.7% |
| 7 | 24 | d0 | 1472 | 109.9% |
| 8 | 24 | d0 & d3 | 1324 | 98.9% |
| 9 | 24 | d3 | 1379 | 103.0% |

TABLE 12

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| HAMSTER | | | | | |
| SEQ ID 8 | CCC TGG AAG GAA AG | CTTTCCTTCCAGG G | SEQ ID 299 | [LR]([5meC])[sP].[LR]([5meC])[sP].[dR](C)[sP].[LR](T)[sP].[dR](G)[sP].[LR](G)[sP].[LR](A)[sP].[dR](A)[sP].[LR](G)[sP].[LR](G)[sP].[dR](A)[sP].[dR](A)[sP].[LR](A)[sP].[LR](G) | 1011 |
| SEQ ID 9 | TTC CCT GGA AGG AA | TTCCTTCCAGGG AA | SEQ ID 300 | [LR](T)[sP].[dR](T)[sP].[LR]([5meC])[sP].[LR]([5meC])[sP].[dR](C)sP].[LR](T)[sP].[LR](G)[sP].[dR](G)[sP].[dR](A)[sP].[LR](A)[sP].[LR](G)[sP].[dR](G)[sP].[LR](A)[sP].[LR](A) | 1012 |
| SEQ ID 10 | TTTC CCT GGA AGG A | TCCTTCCAGGGA AA | SEQ ID 301 | [LR](T)[sP].[LR](T)[sP].[dR](T)[sP].[LR]([5meC])[sP].[LR]([5meC])sP].[dR](C)[sP].[LR](T)[sP].[dR](G)[sP].[LR](G)[sP].[LR](A)[sP].[dR](A)[sP].[dR](G)[sP].[LR](G)[sP].[LR](A) | 1013 |
| SEQ ID 11 | ATT TCC CTG GAA GG | CCTTCCAGGGAA AT | SEQ ID 302 | [LR](A)[sP].[LR](T)[sP].[dR](T)[sP].[dR](T)[sP].[LR]([5meC])[sP].[LR]([5meC])[sP].[dR](C)[sP].[LR](T)[sP].[dR](G)[sP].[LR](G)[sP].[LR](A)[sP].[dR](A)[sP].[LR](G)[sP].[LR](G) | 1014 |
| SEQ ID 12 | CAT TTC CCT GGA AG | CTTCCAGGGAAA TG | SEQ ID 303 | [LR]([5meC])[sP].[LR](A)[sP].[dR](T)[sP].[LR](T)[sP].[dR](T)[sP].[LR]([5meC])[sP].[LR]([5meC])[sP].[dR](C)[sP].[LR](T)[sP].[LR](G)[sP].[dR](G)[sP].[dR](A)[sP].[LR](A)[sP].[LR](G) | 1015 |
| SEQ ID 13 | CCA TTTC CCT GGAA | TTCCAGGGAAAT GG | SEQ ID 304 | [LR]([5meC])[sP].[LR]([5meC])[sP].[dR](A)[sP].[dR](T)[sP].[LR](T)[sP].[LR](T)[sP].[dR](C)[sP].[LR]([5meC])[sP].[LR]([5meC])[sP].[dR](T)[sP].[LR][G][sP].[dR](G)[sP].[LR](A)[sP].[LR](A) | 1016 |
| SEQ ID 14 | TCC ATT TCC CTG GA | TCCAGGGAAATG GA | SEQ ID 305 | [LR](T)[sP].[dR](C)[sP].[dR](C)[sP].[LR](A)[sP].[LR](T)[sP].[dR](T)[sP].[LR](T)[sP].[dR](C)[sP].[LR]([5meC])[sP].[LR]([5meC])[sP].[dR](T)[sP].[dR](G)[sP].[LR](G)[sP].[LR](A) | 1017 |
| SEQ ID 15 | CTC CAT TTC | CCAGGGAAATGG AG | SEQ ID 306 | [LR]([5meC])[sP].[LR](T)[sP].[dR](C)[sP].[dR](C)[sP].[LR](A)[sP].[LR](T)[sP].[dR](T)[sP].[dR](T)[sP].[LR]([5meC])[sP].[LR]([5meC])[sP].[dR](C)[sP].[dR](T)[sP].[LR](G)[sP].[LR](G) | 1018 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CCT<br>GG | | | | |
| SEQ ID 16 | ACT<br>CCA<br>TTTC<br>CCT<br>G | CAGGGAAATGGA<br>GT | SEQ ID 307 | [LR](A)[sP].[dR](C)[sP].[LR](T)[sP].[LR]([5meC])[sP].[dR](C)[sP].[LR] (A)[sP].[LR](T)[sP].[dR](T)[sP].[dR](T)[sP].[LR]([5meC])[sP].[LR] ([5meC])[sP].[dR](C)[sP].[LR](T)[sP].[LR](G) | 1019 |
| SEQ ID 17 | TAC<br>TCC<br>ATT<br>TCC<br>CT | AGGGAAATGGA<br>GTA | SEQ ID 308 | [LR](T)[sP].[dR](A)[sP].[LR]([5meC])[sP].[LR](T)[sP].[dR](C)[sP].[dR] (C)[sP].[LR](A)[sP].[LR](T)[sP].[dR](T)[sP].[LR](T)[sP].[LR]([5meC]) [sP].[dR](C)[sP].[LR]([5meC])[sP].[LR](T) | 1020 |
| SEQ ID 18 | TTA<br>CTC<br>CAT<br>TTC<br>CC | GGGAAATGGAGT<br>AA | SEQ ID 309 | [LR](T)[sP].[LR](T)[sP].[dR](A)[sP].[dR](C)[sP].[LR](T)[sP].[dR](C) [sP].[LR]([5meC])[sP].[LR](A)[sP].[dR](T)[sP].[LR](T)[sP].[LR](T)[sP]. [dR](C)[sP].[LR]([5meC])[sP].[LR]([5meC]) | 1021 |
| SEQ ID 19 | CTT<br>ACT<br>CCA<br>TTTC<br>C | GGAAATGGAGTA<br>AG | SEQ ID 310 | [LR]([5meC])[sP].[LR](T)[sP].[dR](T)[sP].[LR](A)[sP].[dR](C)[sP]. [dR](T)[sP].[LR]([5meC])[sP].[LR]([5meC])[sP].[dR](A)[sP].[LR](T) [sP].[LR](T)[sP].[dR](T)[sP].[LR]([5meC])[sP].[LR]([5meC]) | 1022 |
| SEQ ID 20 | CCT<br>TAC<br>TCC<br>ATT<br>TC | GAAATGGAGTAA<br>GG | SEQ ID 311 | [LR]([5meC])[sP].[LR]([5meC])[sP].[dR](T)[sP].[LR](T)[sP].[dR](A) [sP].[LR]([5meC])[sP].[LR](T)[sP].[dR](C)[sP].[dR](C)[sP].[LR](A) [sP].[LR](T)[sP].[dR](T)[sP].[LR](T)[sP].[LR]([5meC]) | 1023 |
| SEQ ID 21 | GCC<br>TTA<br>CTC<br>CAT<br>TT | AAATGGAGTAAG<br>GC | SEQ ID 312 | [LR](G)[sP].[dR][C)[sP].[LR]([5meC])[sP].[LR](T)[sP].[dR](T)[sP]. [LR](A)[sP].[LR]([5meC])[sP].[dR](T)[sP].[LR]([5meC])[sP].[LR] ([5meC])[sP].[dR](A)[sP].[dR](T)[sP].[LR](T)[sP].[LR](T) | 1024 |
| SEQ ID 22 | GGC<br>CTT<br>ACT<br>CCA<br>TT | AATGGAGTAAGG<br>CC | SEQ ID 313 | [LR](G)[sP].[dR](G)[sP].[LR]([5meC])[sP].[LR]([5meC])[sP].[dR](T) [sP].[dR](T)[sP].[LR](A)[sP].[dR](C)[sP].[LR](T)[sP].[LR]([5meC]) [sP].[dR](C)[sP].[dR](A)[sP].[LR](T)[sP].[LR](T) | 1025 |
| SEQ ID 23 | GAA<br>AGA<br>CCA | CACTTTGGTCTTT<br>C | SEQ ID 314 | [LR](G)[sP].[LR](A)[sP].[dR](A)[sP].[LR](A)[sP].[LR](G)[sP].[dR](A) [sP].[LR]([5meC])[sP].[LR]([5meC])[sP].[dR](A)[sP].[LR](A)[sP]. [LR](A)[sP].[dR](G)[sP].[LR](T)[sP].[LR](G) | 1026 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | AAG TG | | | | |
| SEQ ID 24 | AGG AAA GAC CAA AG | CTTTGGTCTTTCC T | SEQ ID 315 | [LR](A)[sP].[dR](G)[sP].[LR](G)[sP].[LR](A)[sP].[dR](A)[sP].[LR](A)[sP].[LR](G)[sP].[dR](A)[sP].[LR]([5meC])[sP].[LR]([5meC])[sP].[dR](A)[sP].[dR](A)[sP].[LR](A)[sP].[LR](G) | 1027 |
| SEQ ID 25 | GAA GGA AAG ACC AA | TTGGTCTTTCCTT C | SEQ ID 316 | [LR](G)[sP].[LR](A)[sP].[dR](A)[sP].[LR](G)[sP].[LR](G)[sP].[dR](A)[sP].[LR](A)[sP].[LR](A)[sP].[dR](G)[sP].[LR](A)[sP].[LR]([5meC])[sP].[dR][C][sP].[LR](A)[sP].[LR](A) | 1028 |
| SEQ ID 26 | GGA AGG AAA GAC CA | TGGTCTTTCCTTC C | SEQ ID 317 | [LR](G)[sP].[LR](G)[sP].[dR](A)[sP].[LR](A)[sP].[LR](G)[sP].[dR](G)[sP].[LR](A)[sP].[LR](A)[sP].[dR](A)[sP].[LR](G)[sP].[LR](A)[sP].[dR](C)[sP].[LR]([5meC])[sP].[LR](A) | 1029 |
| SEQ ID 27 | TGG AAG GAA AGA CC | GGTCTTTCCTTCC A | SEQ ID 318 | [LR](T)[sP].[LR](G)[sP].[dR](G)[sP].[LR](A)[sP].[LR](A)[sP].[dR](G)[sP].[LR](G)[sP].[LR](A)[sP].[dR](A)[sP].[LR](A)[sP].[LR](G)[sP].[dR](A)[sP][LR]([5meC])[sP].[LR]([5meC]) | 1030 |
| SEQ ID 28 | CTG GAA GGA AAG AC | GTCTTTCCTTCCA G | SEQ ID 319 | [LR]([5meC])[sP].[LR](T)[sP].[dR](G)[sP].[LR](G)[sP].[LR](A)[sP].[dR](A)[sP].[LR](G)[sP].[LR](G)[sP].[dR](A)[sP].[LR](A)[sP].[LR](A)[sP].[dR](G)[sP].[LR](A)[sP].[LR]([5meC]) | 1031 |
| SEQ ID 29 | CCT GGA AGG AAA GA | TCTTTCCTTCCAG G | SEQ ID 320 | [LR]([5meC])[sP].[LR]([5meC])[sP].[dR](T)[sP].[LR](G)[sP].[LR](G)[sP].[dR](A)[sP].[LR](A)[sP].[LR](G)[sP].[dR](G)[sP].[LR](A)[sP].[LR](A)[sP].[dR](A)[sP].[LR][G)[sP].[LR](A) | 1032 |
| SEQ ID 30 | CCC TGG AAG GAA AG | CTTTCCTTCCAGG G | SEQ ID 321 | [LR]([5meC])[sP].[LR]([5meC])[sP].[dR](C)[sP].[LR](T)[sP].[LR](G)[sP].[dR](G)[sP].[LR](A)[sP].[LR][A][sP].[dR](G)[sP].[LR](G)[sP].[LR](A)[sP].[dR](A)[sP].[LR](A)[sP].[LR](G) | 1033 |
| SEQ ID 31 | TCC CTG GAA | TTTCCTTCCAGGG A | SEQ ID 322 | [LR](T)[sP].[LR]([5meC])[sP].[dR](C)[sP].[LR]([5meC])[sP].[LR](T)[sP].[dR](G)[sP].[LR](G)[sP].[LR](A)[sP].[dR](A)[sP].[LR](G)[sP].[LR](G)[sP].[dR](A)[sP].[LR](A)[sP].[LR](A) | 1034 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | GGA AA | | | | |
| SEQ ID 32 | TTC CCT GGA AGG AA | TTCCTTCCAGGG AA | SEQ ID 323 | [LR](T)[sP].[LR](T)[sP].[dR](C)[sP].[LR]([5meC])[sP].[LR]([5meC])[sP].[dR](T)[sP].[LR](G)[sP].[LR](G)[sP].[dR](A)[sP].[LR](A)[sP].[LR](G)[sP].[dR](G)[sP].[LR](A)[sP].[LR](A) | 1035 |
| SEQ ID 33 | TTTC CCT GGA AGG A | TCCTTCCAGGGA AA | SEQ ID 324 | [LR](T)[sP].[LR](T)[sP].[dR](T)[sP].[LR]([5meC])[sP].[LR]([5meC])[sP].[dR](C)[sP].[LR](T)[sP].[LR](G)[sP].[dR](G)[sP].[dR](A)[sP].[LR](A)[sP].[dR](G)[sP].[LR](G)[sP].[LR](A) | 1036 |
| SEQ ID 34 | ATT TCC CTG GAA GG | CCTTCCAGGGAA AT | SEQ ID 325 | [LR](A)[sP].[LR](T)[sP].[dR](T)[sP].[LR](T)[sP].[LR]([5meC])[sP].[dR](C)[sP].[LR]([5meC])[sP].[LR](T)[sP].[dR](G)[sP].[LR](G)[sP].[LR](A)[sP].[dR](G)[sP].[LR](G)[sP].[LR](A) | 1037 |
| SEQ ID 35 | CAT TTC CCT GGA AG | CTTCCAGGGAAA TG | SEQ ID 326 | [LR]([5meC])[sP].[LR](A)[sP].[dR](T)[sP].[dR](T)[sP].[LR](T)[sP].[dR](C)[sP].[LR]([5meC[sP].[LR]([5meC])[sP].[dR](T)[sP].[LR](G)[sP].[LR](G)[sP].[dR](A)[sP].[LR](A)[sP].[LR](G) | 1038 |
| SEQ ID 36 | CCA TTTC CCT GGA A | TTCCAGGGAAAT GG | SEQ ID 327 | [LR]([5meC])[sP].[LR]([5meC])[sP].[dR](A)[sP].[LR](T)[sP].[dR](T)[sP].[dR](T)[sP].[LR]([5meC])[sP].[LR]([5meC])[sP].[dR](C)[sP].[LR](T)[sP].[LR](G)[sP].[dR](G)[sP].[LR](A)[sP].[LR](A) | 1039 |
| SEQ ID 37 | TCC ATT TCC CTG GA | TCCAGGGAAATG GA | SEQ ID 328 | [LR](T)[sP].[LR]([5meC])[sP].[dR][C)[sP].[LR](A)[sP].[LR](T)[sP].[dR](T)[sP].[dR](T)[sP].[LR]([5meC])[sP].[LR]([5meC])[sP].[dR](C)[sP].[LR](T)[sP].[dR](G)[sP].[LR](G)[sP].[LR](A) | 1040 |
| SEQ ID 38 | CTC CAT TTC CCT GG | CCAGGGAAATGG AG | SEQ ID 329 | [LR]([5meC])[sP].[dR](T)[sP].[LR]([5meC])[sP].[dR](C)[sP].[LR](A)[sP].[LR](T)[sP].[dR](T)[sP].[dR](T)[sP].[LR]([5meC])[sP].[LR]([5meC])[sP].[dR](C)[sP].[dR](T)[sP].[LR](G)[sP].[LR](G) | 1041 |
| SEQ ID 39 | ACT CCA TTTC | CAGGGAAATGGA GT | SEQ ID 330 | [LR](A)[sP].[LR]([5meC])[sP].[dR](T)[sP].[LR]([5meC])[sP].[dR](C)[sP].[LR](A)[sP].[LR](T)[sP].[dR](T)[sP].[dR](T)[sP].[LR]([5meC])[sP][LR]([5meC])[sP].[dR](C)[sP].[LR](T)[sP].[LR](G) | 1042 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CCTG | | | | |
| SEQ ID 40 | TACTCCATTTCCCT | AGGGAAATGGAGTA | SEQ ID 331 | [LR](T)[sP].[LR](A)[sP].[dR](C)[sP].[dR](T)[sP].[LR]([5meC])[sP].[LR]([5meC])[sP].[dR](A)[sP].[LR](T)[sP].[LR](T)[sP].[dR](T)[sP].[LR]([5meC])[sP].[dR](C)[sP].[LR]([5meC])[sP].[LR](T) | 1043 |
| SEQ ID 41 | TTACTCCATTTCCC | GGGAAATGGAGTAA | SEQ ID 332 | [LR](T)[sP].[LR](T)[sP].[dR](A)[sP].[LR]([5meC])[sP].[LR](T)[sP].[dR](C)[sP].[LR]([5meC])[sP].[LR](A)[sP].[dR](T)[sP].[LR](T)[sP].[dR](T)[sP].[dR](C)[sP].[LR]([5meC])[sP].[LR]([5meC]) | 1044 |
| SEQ ID 42 | CTTACTCCATTTCC | GGAAATGGAGTAAG | SEQ ID 333 | [LR]([5meC])[sP].[LR](T)[sP].[dR](T)[sP].[LR](A)[sP].[LR]([5meC])[sP].[dR](T)[sP].[LR]([5meC])[sP].[LR]([5meC])[sP].[dR](A)[sP].[LR](T)[sP].[LR](T)[sP].[dR](T)[sP].[LR]([5meC])[sP].[LR]([5meC]) | 1045 |
| SEQ ID 43 | CCTTACTCCATTTC | GAAATGGAGTAAGG | SEQ ID 334 | [LR]([5meC])[sP].[LR]([5meC])[sP].[dR](T)[sP].[LR](T)[sP].[LR](A)[sP].[dR](C)[sP].[LR](T)[sP].[LR]([5meC])[sP].[dR](C)[sP].[LR](A)[sP].[LR](T)[sP].[dR](T)[sP].[LR](T)[sP].[LR]([5meC] | 1046 |
| SEQ ID 44 | GCCTTACTCCATTT | AAATGGAGTAAGGC | SEQ ID 335 | [LR](G)[sP].[LR]([5meC])[sP].[dR](C)[sP].[LR](T)[sP].[LR](T)[sP].[dR](A)[sP].[LR]([5meC])[sP].[LR](T)[sP].[dR](C)[sP].[LR]([5meC])[sP].[dR](A)[sP].[dR](T)[sP].[LR](T)[sP].[LR](T) | 1047 |
| SEQ ID 45 | GGCCTTACTCCATT | AATGGAGTAAGGCC | SEQ ID 336 | [LR](G)[sP].[dR](G)[sP].[dR](C)[sP].[LR]([5meC])[sP].[LR](T)[sP].[dR](T)[sP].[LR](A)[sP].[LR]([5meC])[sP].[dR](T)[sP].[LR]([5meC])[sP].[LR]([5meC])[sP].[dR](A)[sP].[LR](T)[sP].[LR](T) | 1048 |
| SEQ ID 46 | CCGGCCTTACTCCA | TGGAGTAAGGCCGG | SEQ ID 337 | [LR]([5meC])[sP].[LR]([5meC])[sP].[dR](G)[sP].[LR](G)[sP].[dR](C)[sP].[dR](C)[sP].[LR](T)[sP].[dR](T)[sP].[dR](A)[sP].[LR]([5meC])[sP].[LR](T)[sP].[dR](C)[sP].[LR]([5meC])[sP].[LR](A) | 1049 |
| SEQ ID 47 | CACCGGCCT | GAGTAAGGCCGGTG | SEQ ID 338 | [LR]([5meC])[sP].[LR](A)[sP].[dR](C)[sP].[dR](C)[sP].[LR](G)[sP].[dR](G)[sP].[LR]([5meC])[sP].[LR]([5meC])[sP].[dR](T)[sP].[LR](T)[sP].[LR](A)[sP].[dR](C)[sP].[LR](T)[sP].[LR]([5meC]) | 1050 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TAC TC | | | | |
| SEQ ID 48 | CCA CTG GAA ATT AAG AAA | TTTCTTAATTTCC AGTGG | SEQ ID 339 | [LR]([5meC])[sP].[LR]([5meC])[sP].[dR](A)[sP].[dR](C)[sP].[LR](T)[sP].[LR](G)[sP].[dR](G)[sP].[dR](A)[sP].[LR](A)[sP].[dR](A)[sP].[dR](T)[sP].[LR](T)[sP].[LR](A)[sP].[dR](A)[sP].[dR](G)[sP].[dR](A)[sP].[LR](A)[sP].[LR](A) | 1051 |
| SEQ ID 49 | CTG GAA ATT AAG AAA GTG | CACTTTCTTAATT TCCAG | SEQ ID 340 | [LR]([5meC])[sP].[dR](T)[sP].[LR](G)[sP].[LR](G)[sP].[dR](A)[sP].[LR](A)[sP][LR](A)[sP].[dR](T)[sP].[dR](T)[sP].[LR](A)[sP].[dR](A)[sP].[LR](G)[sP].[LR](A)[sP].[dR](A)[sP].[dR](A)[sP].[LR](G)[sP].[LR](T)[sP].[LR](G) | 1052 |
| SEQ ID 50 | GAA ATT AAG AAA GTG ACT | AGTCACTTTCTTA ATTTC | SEQ ID 341 | [LR](G)[sP].[LR](A)[sP].[dR](A)[sP].[dR](A)[sP].[dR](T)[sP].[LR](T)[sP].[LR](A)[sP].[dR](A)[sP].[LR](G)[sP].[LR](A)[sP].[dR](A)[sP].[LR](A)[sP].[LR](G)[sP].[dR](T)[sP].[dR](G)[sP].[dR](A)[sP].[LR]([5meC])[sP].[LR](T) | 1053 |
| SEQ ID 51 | ATT AAG AAA GTG ACT GCT | AGCAGTCACTTTC TTAAT | SEQ ID 342 | [LR](A)[sP].[LR](T)[sP].[dR](T)[sP].[LR](A)[sP].[LR](A)[sP].[dR](G)[sP].[dR](A)[sP].[LR](A)[sP].[dR](A)[sP].[dR]{G)[sP].[dR](T)[sP].[LR](G)[sP].[LR](A)[sP].[dR](C)[sP].[dR](T)[sP].[dR](G)[sP].[LR]([5meC])[sP].[LR](T) | 1054 |
| SEQ ID 52 | AAG AAA GTG ACT GCT TAC | GTAAGCAGTCAC TTTCTT | SEQ ID 343 | [LR](A)[sP].[dR](A)[sP].[dR](G)[sP].[LR](A)[sP].[dR](A)[sP].[LR](A)[sP].[LR](G)[sP].[dR](T)[sP].[dR](G)[sP].[LR](A)[sP].[dR](C)[sP].[dR](T)[sP].[dR](G)[sP].[LR]([5meC])[sP].[LR](T)[sP].[dR](T)[sP].[LR](A)[sP].[LR]([5meC]) | 1055 |
| SEQ ID 53 | AAA GTG ACT GCT TAC CCC | GGGGTAAGCAGT CACTTT | SEQ ID 344 | [LR](A)[sP].[LR](A)[sP].[dR](A)[sP].[dR][G)[sP].[dR](T)[sP].[LR](G)[sP].[dR](A)[sP].[dR][C)[sP].[dR](T)[sP].[LR][G)[sP].[dR](C)[sP].[dR](T)[sP].[dR](T)[sP].[LR](A)[sP].[dR](C)[sP].[dR](C)[sP].[LR]([5meC])[sP].[LR]([5meC.]) | 1056 |
| SEQ ID 54 | GTG ACT GCT | TTAGGGGTAAGC AGTCAC | SEQ ID 345 | [LR](G)[sP].[dR](T)[sP].[LR](G)[sP].[dR](A)[sP].[dR](C)[sP].[dR](T)[sP].[LR](G)[sP].[dR](C)[sP].[dR](T)[sP].[dR](T)[sP].[LR](A)[sP].[dR](C)[sP].[LR]([5meC])[sP].[dR](C)[sP].[dR](C)[sP].[dR](T)[sP].[LR] | 1057 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | TAC CCC TAA | | | (A)[sP].[LR](A) | |
| SEQ ID 55 | ACT GCT TAC CCC TAA CCC | GGGTTAGGGGTA AGCAGT | SEQ ID 346 | [LR](A)[sP].[dR](C)[sP].[dR](T)[sP].[LR](G)[sP].[dR](C)[sP].[dR](T)[sP].[dR](T)[sP].[LR](A)[sP].[dR](C)[sP].[LR]([5meC])[sP].[dR](C)[sP].[dR](C)[sP].[dR](T)[sP].[LR](A)[sP].[dR](A)[sP].[dR][C)[sP].[LR]([5meC])[sP].[LR]([5meC]) | 1058 |
| SEQ ID 56 | GCT TAC CCC TAA CCC TAC | GTAGGGTTAGGG GTAAGC | SEQ ID 347 | [LR](G)[sP].[dR][C)[sP].[dR](T)[sP].[dR](T)[sP].[LR](A)[sP].[dR](C)[sP].[LR]([5meC])[sP].[dR](C)[sP].[dR](C)[sP].[dR](T)[sP].[LR](A)[sP].[dR](A)[sP].[dR](C)[sP].[LR]([5meC])[sP].[dR](C)[sP].[dR](T)[sP].[LR](A)[sP].[LR]([5meC]) | 1059 |
| SEQ ID 57 | TAC CCC TAA CCC TAC CAA | TTGGTAGGGTTA GGGGTA | SEQ ID 348 | [LR](T)[sP].[dR](A)[sP].[dR](C)[sP].[LR]([5meC])[sP].[dR](C)[sP].[dR](C)[sP].[dR](T)[sP].[LR](A)[sP].[dR](A)[sP].[dR](C)[sP].[LR]([5meC])[sP].[dR](C)[sP].[dR](T)[sP].[LR](A)[sP].[dR][C)[sP].[dR](C)[sP].[LR](A)[sP].[LR](A) | 1060 |
| SEQ ID 58 | CCC TAA CCC TAC CAA TAC | GTATTGGTAGGG TTAGGG | SEQ ID 349 | [LR]([5meC])[sP].[dR](C)[sP].[dR](C)[sP].[dR](T)[sP].[LR](A)[sP].[dR](A)[sP].[dR](C)[sP].[LR]([5meC])[sP].[dR](C)[sP].[dR](T)[sP].[LR](A)[sP].[dR](C)[sP].[dR][C)[sP].[LR](A)[sP].[dR](A)[sP].[dR](T)[sP].[LR](A)[sP].[LR]([5meC]) | 1061 |
| SEQ ID 59 | TAA CCC TAC CAA TAC TAA | TTAGTATTGGTA GGGTTA | SEQ ID 350 | [LR](T)[sP].[dR](A)[sP].[dR](A)[sP].[LR]([5meC])[sP].[dR](C)[sP].[dR](C)[sP].[dR](T)[sP].[LR](A)[sP].[dR](C)[sP].[LR]([5meC])[sP].[LR](A)[sP].[dR](A)[sP].[LR](T)[sP].[dR][A][sP].[dR](C)[sP].[dR](T)[sP].[LR](A)[sP][LR](A) | 1062 |
| SEQ ID 60 | CCC TAC CAA TAC TAA CTT | AAGTTAGTATTG GTAGGG | SEQ ID 351 | [LR]([5meC])[sP].[dR](C)[sP].[dR](C)[sP].[dR](T)[sP].[LR](A)[sP].[dR](C)[sP].[dR](C)[sP].[dR](A)[sP].[LR](A)[sP].[dR](T)[sP].[LR](A)[sP].[dR](C)[sP].[dR](T)[sP].[LR](A)[sP].[LR](A)[sP].[dR](C)[sP].[LR]T)[sP].[LR](T) | 1063 |
| SEQ ID 61 | TAC CAA | AAGAAGTTAGTA TTGGTA | SEQ ID 352 | [LR](T)[sP].[dR](A)[sP].[LR]([5meC])[sP].[dR](C)[sP].[LR](A)[sP].[LR](A)[sP].[dR](T)[sP].[LR](A)[sP].[LR]([5meC])[sP].[dR](T)[sP].[dR] | 1064 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TAC TAA CTT CTT | | | (A)[sP].[LR](A)[sP].[LR]([5meC])[sP].[dR](T)[sP].[dR](T)[sP].[dR](C)[sP].[LR](T)[sP].[LR](T) | |
| SEQ ID 62 | CAA TAC TAA CTT CTTT CT | AGAAAGAAGTTAGTATTG | SEQ ID 353 | [LR]([5meC])[sP].[dR](A)[sP].[dR](A)[sP].[LR](T)[sP].[dR](A)[sP].[dR](C)[sP].[dR](T)[sP].[LR](A)[sP].[dR](A)[sP].[LR]([5meC])[sP].[LR](T)[sP].[dR](T)[sP].[dR](C)[sP].[LR](T)[sP].[dR](T)[sP].[LR](T)[sP].[LR]([5meC])[sP].[LR](T) | 1065 |
| SEQ ID 63 | TAC TAA CTT CTTT CTC CA | TGGAGAAAGAAGTTAGTA | SEQ ID 354 | [LR](T)[sP].[dR](A)[sP].[dR](C)[sP].[dR](T)[sP].[LR](A)[sP].[dR](A)[sP].[dR](C)[sP].[dR](T)[sP].[LR](T)[sP].[dR](C)[sP].[LR](T)[sP].[dR](T)[sP].[LR](T)[sP].[dR](C)[sP].[dR](T)[sP].[dR](C)[sP].[LR]([5meC])[sP][R](A) | 1066 |
| SEQ ID 64 | TAA CTT CTTT CTC CAT TT | AAATGGAGAAAGAAGTTA | SEQ ID 355 | [LR](T)[sP].[dR](A)[sP].[LR](A)[sP].[LR]([5meC])[sP].[dR](T)[sP].[dR](T)[sP].[dR](C)[sP].[LR](T)[sP].[dR](T)[sP].[dR](T)[sP].[dR](C)[sP].[LR](T)[sP].[dR][C)[sP].[dR][C][sP].[LR](A)[sP].[dR](T)[sP].[LR](T)[sP].[LR](T) | 1067 |
| SEQ ID 65 | CTT CTTT CTC CAT TTG CC | GGCAAATGGAGAAAGAAG | SEQ ID 356 | [LR]([5meC])[sP].[dR](T)[sP].[dR](T)[sP].[dR](C)[sP].[LR](T)[sP].[dR](T)[sP].[dR](T)[sP].[dR][C)[sP].[LR](T)[sP].[dR](C)[sP].[dR](C)[sP].[LR](A)[sP].[dR](T)[sP].[LR](T)[sP].[dR](T)[sP].[dR](G)[sP].[LR]([5meC])[sP].[LR]([5meC]) | 1068 |
| SEQ ID 66 | CTTT CTC CAT TTG CCT GG | CCAGGCAAATGGAGAAAG | SEQ ID 357 | [LR]([5meC])[sP].[dR](T)[sP].[LR](T)[sP].[dR](T)[sP].[dR](C)[sP].[LR](T)[sP].[dR](C)[sP].[dR](C)[sP].[LR](A)[sP].[dR](T)[sP].[dR](T)[sP].[dR](T)[sP].[LR](G)[sP].[dR](C)[sP].[dR](C)[sP].[dR](T)[sP].[LR](G)[sP].[LR](G) | 1069 |
| SEQ ID 67 | TCT CCA TTT GCC TGG CTA | TAGCCAGGCAAATGGAGA | SEQ ID 358 | [LR](T)[sP].[dR](C)[sP].[LR](T)[sP].[dR](C)[sP].[dR](C)[sP].[LR](A)[sP].[dR](T)[sP].[dR](T)[sP].[dR](T)[sP].[LR][G][sP].[dR](C)[sP].[dR](C)[sP].[dR](T)[sP].[LR](G)[sP].[dR](G)[sP].[dR](C)[sP].[LR](T)[sP].[LR](A) | 1070 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 68 | CCA TTT GCC TGG CTA GGC | GCCTAGCCAGGC AAATGG | SEQ ID 359 | [LR]([5meC])[sP].[dR](C)[sP].[LR](A)[sP].[dR](T)[sP].[dR](T)[sP].[dR](T)[sP].[LR](G)[sP].[dR](C)[sP].[dR][C)[sP].[dR](T)[sP].[LR](G)[sP].[dR](G)[sP].[dR](C)[sP].[dR](T)[sP].[LR](A)[sP].[dR][G)[sP].[LR](G)[sP].[LR]([5meC]) | 1071 |
| SEQ ID 69 | TTT GCC TGG CTA GGC ATG | CATGCCTAGCCA GGCAAA | SEQ ID 360 | [LR](T)[sP].[dR](T)[sP].[dR](T)[sP].[LR](G)[sP].[dR](C)[sP].[dR](C)[sP].[dR](T)[sP].[LR](G)[sP].[dR](G)[sP].[dR](C)[sP].[dR](T)[sP].[LR](A)[sP].[dR](G)[sP].[dR](G)[sP].[dR](C)[sP].[LR][A][sP].[LR](T)[sP].[LR](G) | 1072 |
| SEQ ID 70 | GCC TGG CTA GGC ATG TCA | TGACATGCCTAG CCAGGC | SEQ ID 361 | [LR](G)[sP].[dR](C)[sP].[dR](C)[sP].[dR](T)[sP].[LR](G)[sP].[dR](G)[sP].[dR](C)[sP].[dR](T)[sP].[LR](A)[sP].[dR](G)[sP].[dR](G)[sP].[dR](C)[sP].[LR](A)[sP].[dR](T)[sP].[dR](G)[sP].[dR](T)[sP].[LR]([5meC])[sP].[LR](A) | 1073 |
| SEQ ID 71 | TGG CTA GGC ATG TCA CAC | GTGTGACATGCC TAGCCA | SEQ ID 362 | [LR](T)[sP].[dR](G)[sP].[LR](G)[sP].[dR][C)[sP].[dR](T)[sP].[LR](A)[sP].[dR][G)[sP].[dR](G)[sP].[dR](C)[sP].[LR](A)[sP].[dR](T)[sP].[LR](G)[sP].[dR](T)[sP].[dR](C)[sP].[LR](A)[sP].[dR](C)[sP].[LR](A)[sP].[LR]([5meC]) | 1074 |
| SEQ ID 72 | CTA GGC ATG TCA CAC ATC | GATGTGTGACAT GCCTAG | SEQ ID 363 | [LR]([5meC])[sP].[dR](T)[sP].[LR](A)[sP].[dR](G)[sP].[dR][G)[sP].[dR](C)[sP].[LR](A)[sP].[dR](T)[sP].[LR](G)[sP].[dR](T)[sP].[dR](C)[sP).[LR](A)[sP].[dR](C)[sP].[LR](A)[sP].[dR](C)[sP].[dR](A)[sP].[LR](T)[sP].[LR]([5meC]) | 1075 |
| SEQ ID 73 | GGC ATG TCA CAC ATC ATA | TATGATGTGTGA CATGCC | SEQ ID 364 | [LR](G)[sP].[dR](G)[sP].[dR](C)[sP].[LR](A)[sP].[dR](T)[sP].[LR](G)[sP].[dR](T)[sP].[dR](C)[sP].[LR](A)[sP].[dR](C)[sP].[dR](A)[sP].[dR](C)[sP].[LR](A)[sP].[dR](T)[sP].[dR](C)[sP].[dR](A)[sP].[LR](T)[sP].[LR](A) | 1076 |
| SEQ ID 74 | ATG TCA CAC | ATATATGATGTG TGACAT | SEQ ID 365 | [LR](A)[sP].[dR](T)[sP].[LR](G)[sP].[LR](T)[sP].[dR](C)[sP].[dR](A)[sP].[LR]([5meC])[sP].[dR](A)[sP].[dR](C)[sP].[dR](A)[sP].[LR](T)[sP].[dR](C)[sP].[dR](A)[sP].[LR](T)[sP].[LR](A)[sP].[dR](T)[sP].[LR] | 1077 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | ATC ATA TAT | | | (A)[sP].[LR](T) | |
| SEQ ID 75 | TCA CAC ATC ATA TAT ATA | TATATATATGATG TGTGA | SEQ ID 366 | [LR](T)[sP].[LR]([5meC])[sP].[dR](A)[sP].[dR](C)[sP].[dR](A)[sP].[LR] ([5meC])[sP].[LR](A)[sP].[dR](T)[sP].[dR](C)[sP].[dR](A)[sP].[LR] (T)[sP].[dR](A)[sP].[LR](T)[sP].[dR](A)[sP].[LR](T)[sP].[dR](A)[sP]. [LR](T)[sP].[LR](A) | 1078 |
| SEQ ID 76 | CAC ATC ATA TAT ATA CTA | TAGTATATATATG ATGTG | SEQ ID 367 | [LR]([5meC])[sP].[LR](A)[sP].[dR][C)[sP].[LR](A)[sP].[dR](T)[sP].[dR] (C)[sP].[dR](A)[sP].[LR](T)[sP].[dR](A)[sP].[dR](T)[sP].[LR](A)[sP]. [LR](T)[sP].[dR](A)[sP].[LR](T)[sP].[LR](A)[sP].[dR](C)[sP].[LR] (T)[sP].[LR](A) | 1079 |
| SEQ ID 77 | ATC ATA TAT ATA CTA CAG | CTGTAGTATATAT ATGAT | SEQ ID 368 | [LR](A)[sP].[LR](T)[sP].[dR](C)[sP].[dR](A)[sP].[LR](T)[sP].[LR](A)[sP]. [dR](T)[sP].[dR](A)[sP].[LR](T)[sP].[LR](A)[sP].[dR](T)[sP].[LR] (A)[sP].[dR](C)[sP].[dR](T)[sP].[dR](A)[sP].[LR]([5meC])[sP].[LR](A) [sP].[LR](G) | 1080 |
| SEQ ID 78 | ATA TAT ATA CTA CAG AAT | ATTCTGTAGTATA TATAT | SEQ ID 369 | [LR](A)[sP].[LR](T)[sP].[dR](A)[sP].[LR](T)[sP].[dR](A)[sP].[LR](T)[sP]. [LR](A)[sP].[dR](T)[sP].[LR](A)[sP].[dR](C)[sP].[LR](T)[sP].[dR] (A)[sP].[LR]([5meC][sP].[LR](A)[sP].[dR][G)[sP].[LR](A)[sP].[LR](A) [sP].[LR](T) | 1081 |
| SEQ ID 79 | TAT ATA CTA CAG AAT GAG | CTCATTCTGTAGT ATATA | SEQ ID 370 | [LR](T)[sP].[LR](A)[sP].[dR](T)[sP].[LR](A)[sP].[LR](T)[sP].[dR](A)[sP]. [dR][C)[sP].[LR](T)[sP].[dR](A)[sP].[LR]([5meC])[sP].[dR](A)[sP]. [dR](G)[sP].[LR](A)[sP].[LR](A)[sP].[dR](T)[sP].[LR](G)[sP].[LR](A) [sP].[LR](G) | 1082 |
| SEQ ID 80 | ATA CTA CAG AAT GAG CCA | TGGCTCATTCTGT AGTAT | SEQ ID 371 | [LR](A)[sP].[dR](T)[sP].[LR](A)[sP].[dR](C)[sP].[dR](T)[sP].[LR](A)[sP]. [dR](C)[sP].[dR](A)[sP].[dR](G)[sP].[LR](A)[sP].[LR](A)[sP].[dR] (T)[sP].[LR](G)[sP].[dR](A)[sP].[LR](G)[sP].[dR](C)[sP].[LR]([5meC]) [sP].[LR](A) | 1083 |
| SEQ ID 81 | CTA CAG | GATTGGCTCATTC TGTAG | SEQ ID 372 | [LR]([5meC])[sP].[dR](T)[sP].[dR](A)[sP].[LR]([5meC][sP].[dR](A) [sP].[LR](G)[sP].[dR](A)[sP].[dR](A)[sP].[dR](T)[sP].[LR](G)[sP].[dR] | 1084 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | AAT GAG CCA ATC | | | (A)[sP].[dR](G)[sP].[LR]([5meC])[sP].[dR](C)[sP].[LR](A)[sP].[dR](A)[sP].[LR](T)[sP].[LR]([5meC]) | |
| SEQ ID 82 | CAG AAT GAG CCA ATC TTA | TAAGATTGGCTCATTCTG | SEQ ID 373 | [LR]([5meC])[sP].[dR](A)[sP].[LR](G)[sP].[dR](A)[sP].[LR](A)[sP].[dR](T)[sP][LR](G)[sP].[dR](A)[sP].[LR](G)[sP].[dR](C)[sP].[dR](C)[sP].[LR](A)[sP].[LR](A)[sP].[dR](T)[sP].[dR](C)[sP].[dR](T)[sP].[LR](T)[sP].[LR](A) | 1085 |
| SEQ ID 83 | AAT GAG CCA ATC TTA CAC | GTGTAAGATTGGCTCATT | SEQ ID 374 | [LR](A)[sP].[dR](A)[sP].[LR](T)[sP].[LR](G)[sP].[dR](A)[sP].[dR](G)[sP].[LR]([5meC])[sP].[dR](C)[sP].[dR](A)[sP].[dR](A)[sP].[LR](T)[sP].[dR](C)[sP].[LR](T)[sP].[dR](T)[sP].[dR](A)[sP].[dR](C)[sP].[LR](A)[sP].[LR]([5meC]) | 1086 |
| SEQ ID 84 | GAG CCA ATC TTA CAC AGT | ACTGTGTAAGATTGGCTC | SEQ ID 375 | [LR](G)[sP].[dR](A)[sP].[dR](G)[sP].[dR][C)[sP].[LR]([5meC])[sP].[dR](A)[sP].[dR](A)[sP].[LR](T)[sP].[dR](C)[sP].[dR](T)[sP].[dR](T)[sP].[LR](A)[sP].[dR](C)[sP].[LR](A)[sP].[dR](C)[sP].[dR](A)[sP].[LR](G)[sP].[LR](T) | 1087 |
| SEQ ID 85 | CCA ATC TTA CAC AGT GCT | AGCACTGTGTAAGATTGG | SEQ ID 376 | [LR]([5meC])[sP].[dR](C)[sP].[dR](A)[sP].[dR](A)[sP].[LR](T)[sP].[dR](C)[sP].[dR](T)[sP].[dR](T)[sP].[LR](A)[sP].[dR](C)[sP].[dR](A)[sP].[dR](C)[sP].[LR](A)[sP].[dR](G)[sP].[dR](T)[sP].[dR](G)[sP].[LR]([5meC])[sP].[LR](T) | 1088 |
| SEQ ID 86 | ATC TTA CAC AGT GCT TTA | TAAAGCACTGTGTAAGAT | SEQ ID 377 | [LR](A)[sP].[dR](T)[sP].[dR](C)[sP].[LR](T)[sP].[dR](T)[sP].[dR][A)[sP].[dR](C)[sP].[LR](A)[sP].[dR](C)[sP].[dR](A)[sP].[dR](G)[sP].[LR](T)[sP].[dR](G)[sP].[dR](C)[sP].[LR](T)[sP].[dR](T)[sP].[LR](T)[sP].[LR](A) | 1089 |
| SEQ ID 87 | TTA CAC AGT GCT TTA GTA | TACTAAAGCACTGTGTAA | SEQ ID 378 | [LR](T)[sP].[dR](T)[sP].[LR](A)[sP].[dR](C)[sP].[LR](A)[sP].[dR](C)[sP].[LR](A)[sP].[dR](G)[sP].[LR](T)[sP].[dR](G)[sP].[dR](C)[sP].[dR](T)[sP].[LR](T)[sP].[dR](T)[sP].[dR](A)[sP].[dR](G)[sP].[LR](T)[sP].[LR](A) | 1090 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 88 | CAC AGT GCT TTA GTA AGG | CCTTACTAAAGCA CTGTG | SEQ ID 379 | [LR]([5meC])[sP].[dR](A)[sP].[dR][C)[sP].[LR](A)[sP].[dR][G][sP].[dR](T)[sP].[LR](G)[sP].[dR](C)[sP].[dR](T)[sP].[dR](T)[sP].[LR](T)[sP].[dR](A)[sP].[dR][G)[sP].[dR](T)[sP].[LR](A)[sP].[dR](A)[sP].[LR](G)[sP].[LR](G) | 1091 |
| SEQ ID 89 | AGT GCT TTA GTA AGG CAA | TTGCCTTACTAAA GCACT | SEQ ID 380 | [LR](A)[sP].[dR](G)[sP].[dR](T)[sP].[dR](G)[sP].[LR]([5meC])[sP].[dR](T)[sP].[dR](T)[sP].[dR](T)[sP].[LR](A)[sP].[dR](G)[sP].[dR](T)[sP].[LR](A)[sP].[dR](A)[sP].[dR](G)[sP].[LR](G)[sP].[dR](C)[sP].[LR](A)[sP].[LR](A) | 1092 |
| SEQ ID 90 | GCT TTA GTA AGG CAA ACA | TGTTTGCCTTACT AAAGC | SEQ ID 381 | [LR](G)[sP].[dR](C)[sP].[dR](T)[sP].[LR](T)[sP].[LR](T)[sP].[dR](A)[sP].[dR](G)[sP].[dR](T)[sP].[LR](A)[sP].[dR](A)[sP].[dR][G][sP].[dR](G)[sP].[LR]([5meC])[sP].[dR](A)[sP].[dR](A)[sP].[dR](A)[sP].[LR]([5meC])[sP].[LR](A) | 1093 |
| SEQ ID 91 | TTA GTA AGG CAA ACA AGC | GCTTGTTTGCCTT ACTAA | SEQ ID 382 | [LR](T)[sP].[dR](T)[sP].[LR](A)[sP].[LR](G)[sP].[dR](T)[sP].[dR](A)[sP].[dR](A)[sP].[LR](G)[sP].[dR](G)[sP].[dR](C)[sP].[LR](A)[sP].[dR](A)[sP].[dR](A)[sP].[dR](C)[sP].[LR](A)[sP].[dR](A)[sP].[LR](G)[sP].[LR]([5meC]) | 1094 |
| SEQ ID 92 | GTA AGG CAA ACA AGC TCT | AGAGCTTGTTTG CCTTAC | SEQ ID 383 | [LR](G)[sP].[dR](T)[sP].[dR](A)[sP].[LR](A)[sP].[dR][G)[sP].[dR](G)[sP].[dR](C)[sP].[LR](A)[sP].[dR](A)[sP].[dR](A)[sP].[dR](C)[sP].[LR](A)[sP].[dR](A)[sP].[LR](G)[sP].[dR](C)[sP].[dR](T)[sP].[LR]([5meC])[sP].[LR](T) | 1095 |
| SEQ ID 93 | AGG CAA ACA AGC TCT ACC | GGTAGAGCTTGT TTGCCT | SEQ ID 384 | [LR](A)[sP].[dR](G)[sP].[dR](G)[sP].[dR](C)[sP].[LR](A)[sP].[dR](A)[sP].[dR](A)[sP].[dR](C)[sP].[LR](A)[sP].[dR](A)[sP].[dR](G)[sP].[dR](C)[sP].[LR](T)[sP].[dR](C)[sP].[dR](T)[sP].[dR](A)[sP].[LR]([5meC])[sP].[LR]([5meC]) | 1096 |
| SEQ ID 94 | CAA ACA AGC TCT | CGAGGTAGAGCT TGTTTG | SEQ ID 385 | [LR]([5meC])[sP].[dR](A)[sP].[LR](A)[sP].[dR](A)[sP].[dR](C)[sP].[LR](A)[sP].[dR](A)[sP].[dR](G)[sP].[dR](C)[sP].[LR](T)[sP].[dR](C)[sP].[dR](T)[sP].[LR](A)[sP].[dR](C)[sP].[dR](C)[sP].[dR](T)[sP].[LR]([5meC])[sP].[LR](G) | 1097 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | ACC TCG | | | | |
| SEQ ID 95 | ACA AGC TCT ACC TCG GAG | CTCCGAGGTAGA GCTTGT | SEQ ID 386 | [LR](A)[sP].[dR](C)[sP].[LR](A)[sP].[dR](A)[sP].[dR](G)[sP][dR](C)[sP].[LR](T)[sP].[dR](C)[sP].[dR](T)[sP].[LR](A)[sP].[dR](C)[sP].[dR](C)[sP].[LR](T)[sP].[dR]([5meC])[sP].[dR](G)[sP].[dR](G)[sP].[LR](A)[sP].[LR](G) | 1098 |
| SEQ ID 96 | AGC TCT ACC TCG GAG TCT | AGACTCCGAGGT AGAGCT | SEQ ID 387 | [LR](A)[sP].[dR](G)[sP].[dR](C)[sP].[LR](T)[sP].[dR](C)[sP].[dR](T)[sP].[dR](G)[sP].[LR](G)[sP].[dR](A)[sP].[dR](G)[sP].[dR](T)[sP].[LR]([5meC])[sP].[LR](T) | 1099 |
| SEQ ID 97 | TCT ACC TCG GAG TCT GAA | TTCAGACTCCGA GGTAGA | SEQ ID 388 | [LR](T)[sP].[dR][C)[sP].[dR](T)[sP].[LR](A)[sP].[dR](C)[sP].[dR](C)[sP].[LR](T)[sP].[dR]([5meC])[sP].[dR](G)[sP].[LR](G)[sP].[dR](A)[sP].[dR](G)[sP].[LR](T)[sP].[dR](C)[sP].[dR](T)[sP].[dR](G)[sP].[R](A)[sP].[LR](A) | 1100 |
| SEQ ID 98 | ACC TCG GAG TCT GAA GAG | CTCTTCAGACTCC GAGGT | SEQ ID 389 | [LR](A)[sP].[dR](C)[sP].[dR](C)[sP].[dR](T)[sP].[LR]([5meC])[sP].[dR](G)[sP].[dR](G)[sP].[dR](A)[sP].[LR](G)[sP].[dR](T)[sP].[dR](C)[sP].[dR](T)[sP].[LR](G)[sP].[dR](A)[sP].[dR](A)[sP].[dR](G)[sP].[LR](A)[sP].[LR](G) | 1101 |
| SEQ ID 99 | TCG GAG TCT GAA GAG TCA | TGACTCTTCAGAC TCCGA | SEQ ID 390 | [LR](T)[sP].[dR]([5meC])[sP].[dR](G)[sP].[LR](G)[sP].[dR](A)[sP].[dR](G)[sP].[LR](T)[sP].[dR](C)[sP].[dR](T)[sP].[LR](G)[sP].[dR](A)[sP].[dR](A)[sP].[LR](G)[sP].[dR](A)[sP].[dR](G)[sP].[dR](T)[sP].[LR]([5meC])[sP].[LR](A) | 1102 |
| SEQ ID 100 | GAG TCT GAA GAG TCA ACA | TGTTGACTCTTCA GACTC | SEQ ID 391 | [LR](G)[sP].[dR](A)[sP].[dR](G)[sP].[LR](T)[sP].[dR](C)[sP].[dR](T)[sP].[dR](G)[sP].[LR](A)[sP].[dR](A)[sP].[LR](G)[sP].[dR](A)[sP].[dR](G)[sP].[dR](T)[sP].[LR]([5meC])[sP].[dR](A)[sP].[dR](A)[sP].[LR]([5meC])[sP].[LR](A) | 1103 |
| SEQ ID 101 | TCT GAA GAG | CACTGTTGACTCT TCAGA | SEQ ID 392 | [LR](T)[sP].[dR](C)[sP].[dR](T)[sP].[LR](G)[sP].[dR](A)[sP].[dR](A)[sP].[dR](G)[sP].[LR](A)[sP].[dR](G)[sP].[LR](T)[sP].[dR](C)[sP].[LR](A)[sP].[LR](A)[sP].[dR][C][sP].[LR](A)[sP].[dR](G)[sP].[LR](T)[sP]. | 1104 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TCA ACA GTG | | | [LR](G) | |
| SEQ ID 102 | GAA GAG TCA ACA GTG TCA | TGACACTGTTGA CTCTTC | SEQ ID 393 | [LR](G)[sP].[dR](A)[sP].[dR](A)[sP].[dR](G)[sP].[LR](A)[sP].[dR](G)[sP].[dR](T)[sP].[dR](C)[sP].[LR](A)[sP].[dR](A)[sP].[dR](C)[sP].[dR](A)[sP].[LR](G)[sP].[dR](T)[sP].[LR](G)[sP].[dR](T)[sP].[LR](/5meC])[sP].[LR](A) | 1105 |
| SEQ ID 103 | GAG TCA ACA GTG TCA GAA | TTCTGACACTGTT GACTC | SEQ ID 394 | [LR](G)[sP].[dR](A)[sP].[LR](G)[sP].[dR](T)[sP].[LR]([5meC])[sP].[dR](A)[sP].[dR](A)[sP].[dR][C)[sP].[LR](A)[sP].[dR](G)[sP].[dR](T)[sP].[dR](G)[sP].[LR](T)[sP].[dR](C)[sP].[LR](A)[sP].[dR](G)[sP].[LR](A)[sP].[LR](A) | 1106 |
| SEQ ID 104 | TCA ACA GTG TCA GAA TCC | GGATTCTGACAC TGTTGA | SEQ ID 395 | [LR](T)[sP].[dR](C)[sP].[LR](A)[sP].[dR](A)[sP].[dR](C)[sP].[LR](A)[sP].[dR](G)[sP].[dR](T)[sP].[LR](G)[sP].[dR](T)[sP].[dR](C)[sP].[dR](A)[sP].[LR](G)[sP].[dR](A)[sP].[dR](A)[sP].[dR](T)[sP].[LR]([5meC])[sP].[LR]([5meC]) | 1107 |
| SEQ ID 105 | ACA GTG TCA GAA TCC ATG | CATGGATTCTGA CACTGT | SEQ ID 396 | [LR](A)[sP].[dR](C)[sP].[LR](A)[sP].[dR](G)[sP].[dR](T)[sP].[LR](G)[sP].[dR](T)[sP].[dR](C)[sP].[LR](A)[sP].[dR][G][sP].[dR](A)[sP].[dR](A)[sP].[LR](T)[sP].[dR](C)[sP].[dR](C)[sP].[dR](A)[sP].[LR](T)[sP].[LR](G) | 1108 |
| SEQ ID 106 | GTG TCA GAA TCC ATG GGA | TCCCATGGATTCT GACAC | SEQ ID 397 | [LR](G)[sP].[dR](T)[sP].[dR](G)[sP].[dR](T)[sP].[LR]([5meC])[sP].[dR](A)[sP].[dR](G)[sP].[dR](A)[sP].[LR](A)[sP].[dR](T)[sP].[dR](C)[sP].[dR](C)[sP].[LR](A)[sP].[dR](T)[sP].[dR](G)[sP].[dR](G)[sP].[LR](G)[sP].[LR](A) | 1109 |
| SEQ ID 107 | TCA GAA TCC ATG GGA AGA | TCTTCCCATGGAT TCTGA | SEQ ID 398 | [LR](T)[sP].[dR](C)[sP].[LR](A)[sP].[dR](G)[sP].[dR][A)[sP].[LR](A)[sP].[dR](T)[sP].[dR](C)[sP].[dR][C)[sP].[LR](A)[sP].[dR](T)[sP].[dR](G)[sP].[dR](G)[sP].[LR](G)[sP].[dR](A)[sP].[dR](A)[sP].[LR](G)[sP].[LR](A) | 1110 |
| SEQ ID 108 | GAA TCC | ACATCTTCCCATG GATTC | SEQ ID 399 | [LR](G)[sP].[dR](A)[sP].[LR](A)[sP].[dR](T)[sP].[dR](C)[sP].[dR](C)[sP].[LR](A)[sP].[dR](T)[sP].[LR](G)[sP].[dR](G)[sP].[dR](G)[sP].[dR] | 1111 |

TABLE 12-continued

| Compound Table; compounds comprising modified nucleosides (SEQ ID NOs: 1011-1496). | | | | | |
|---|---|---|---|---|---|
| Motif SEQ ID | Motif Sequence | Target site sequence | Target SEQ | Compounds (HELM ANNOTATION) | SEQ ID NO. |
| | ATG GGA AGA TGT | | | (A)[sP].[LR](A)[sP].[dR](G)[sP].[dR](A)[sP].[dR](T)[sP].[LR](G)[sP].[LR](T) | |
| SEQ ID 109 | TCC ATG GGA AGA TGT TCT | AGAACATCTTCCCATGGA | SEQ ID 400 | [LR](T)[sP].[dR](C)[sP].[dR](C)[sP].[LR](A)[P].[dR](T)[sP].[dR](G)[sP].[dR](G)[sP].[LR](G)[sP].[dR](A)[sP].[dR](A)[sP].[dR](G)[sP].[LR](A)[sP].[dR](T)[sP].[LR](G)[sP].[dR](T)[sP].[dR](T)[sP].[LR]([5meC])[sP].[LR](T) | 1112 |
| SEQ ID 110 | ATG GGA AGA TGT TCT GGG | CCCAGAACATCTTCCCAT | SEQ ID 401 | [LR](A)[sP].[dR](T)[sP].[dR](G)[sP].[dR](G)[sP].[LR](G)[sP].[dR](A)[sP].[dR](A)[sP].[dR](G)[sP].[LR](A)[sP].[dR](T)[sP].[dR](G)[sP].[dR](T)[sP][LR](T)[sP].[dR](C)[sP].[dR](T)[sP].[dR](G)[sP].[LR](G)[sP].[LR](G) | 1113 |
| SEQ ID 111 | GGA AGA TGT TCT GGG GAG | CTCCCCAGAACATCTTCC | SEQ ID 402 | [LR](G)[sP].[dR](G)[sP].[dR](A)[sP].[dR](A)[sP].[LR](G)[sP].[dR](A)[sP].[dR](T)[sP].[dR](G)[sP].[LR](T)[sP].[dR](T)[sP].[dR](C)[sP].[dR](T)[sP].[LR](G)[sP].[dR](G)[sP].[dR](G)[sP].[dR](G)[sP].[LR](A)[sP].[LR](G) | 1114 |
| SEQ ID 112 | AGA TGT TCT GGG GAG GTG | CACCTCCCCAGAACATCT | SEQ ID 403 | [LR](A)[sP].[dR](G)[sP].[dR](A)[sP].[dR](T)[sP].[LR](G)[sP].[dR](T)[sP].[dR](T)[sP].[dR](C)[sP].[LR](T)[sP].[dR](G)[sP].[dR](G)[sP].[dR](G)[sP].[LR](G)[sP].[dR](A)[sP].[dR](G)[sP].[dR](G)[sP].[LR](T)[sP].([LR](G) | 1115 |
| SEQ ID 113 | TGT TCT GGG GAG GTG ACA | TGTCACCTCCCCAGAACA | SEQ ID 404 | [LR](T)[sP].[dR](G)[sP].[dR](T)[sP].[LR](T)[sP].[dR](C)[sP].[dR](T)[sP].[LR](G)[sP].[dR](G)[sP].[dR](G)[sP].[dR][G)[sP].[LR](A)[sP].[dR](G)[sP].[dR](G)[sP].[dR](T)[sP].[LR](G)[sP].[dR](A)[sP].[LR]([5meC])[sP].[LR](A) | 1116 |
| SEQ ID 114 | TCT GGG GAG GTG ACA ACT | AGTTGTCACCTCCCCAGA | SEQ ID 405 | [LR](T)[sP].[dR](C)[sP].[dR](T)[sP].[LR][G][sP].[dR](G)[sP].[dR](G)[sP].[dR](G)[sP].[LR](A)[sP].[dR](G)[sP].[dR](G)[sP].[dR](T)[sP].[LR](G)[sP].[dR](A)[sP].[dR](C)[sP].[LR](A)[sP].[dR](A)[sP].[LR]([5meC])[sP].[LR](T) | 1117 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 115 | GGG GAG GTG ACA ACT GGG | CCCAGTIGTCACC TCCCC | SEQ ID 406 | [LR](G)[sP].[dR](G)[sP].[dR](G)[sP].[dR](G)[sP].[LR](A)[sP].[dR](G)[sP].[dR](G)[sP].[dR](T)[sP].[LR](G)[sP].[dR](A)[sP].[dR][C][sP].[dR](A)[sP].[LR](A)[sP].[dR](C)[sP].[dR](T)[sP].[dR][G][sP].[LR](G)[sP].[LR](G) | 1118 |
| SEQ ID 116 | GAG GTG ACA ACT GGG CCT | AGGCCCAGTIGT CACCTC | SEQ ID 407 | [LR](G)[sP].[dR](A)[sP].[dR](G)[sP].[LR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[LR](T) | 1119 |
| SEQ ID 117 | GTG ACA ACT GGG CCT GCA | TGCAGGCCCAGT TGTCAC | SEQ ID 408 | [LR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR](G)[sP].[LR]([5meC])[sP].[LR](A) | 1120 |
| SEQ ID 118 | ACA ACT GGG CCT GCA CCT | AGGTGCAGGCCC AGTTGT | SEQ ID 409 | [LR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR][G][sP].[dR](C)[sP].[LR](A)[sP].[dR](C)[sP].[LR]([5meC])[sP].[LR](T) | 1121 |
| SEQ ID 119 | ACT GGG CCT GCA CCT GCT | AGCAGGTGCAGG CCCAGT | SEQ ID 410 | [LR](A)[sP].[dR](C)[sP].[dR](T)[sP].[LR](G)[sP].[dR](G)[sP].[dR](G)[sP].[dR][C)[sP].[LR]([5meC])[sP].[dR](T)[sP].[dR][G)[sP].[dR](C)[sP].[LR](A)[sP].[dR](C)[sP].[LR]([5meC])[sP].[dR](T)[sP].[dR](G)[sP].[LR]([5meC])[sP].[LR](T) | 1122 |
| SEQ ID 120 | GGG CCT GCA CCT GCT GCA | TGCAGCAGGTGC AGGCCC | SEQ ID 411 | [LR](G)[sP].[dR](G)[sP].[dR](G)[sP].[dR](C)[sP].[LR]([5meC])[sP].[dR](T)[sP].[dR](G)[sP].[dR](C)[sP].[LR](A)[sP].[dR](C)[sP].[dR](C)[sP].[dR](T)[sP].[LR](G)[sP].[dR](C)[sP].[dR](T)[sP].[dR](G)[sP].[LR]([5meC])[sP].[LR](A) | 1123 |
| SEQ ID 121 | CCT GCA CCT GCT | CTCTGCAGCAGG TGCAGG | SEQ ID 412 | [LR]([5meC])[sP].[dR](C)[sP].[dR](T)[sP].[LR](G)[sP].[dR][C)[sP].[LR](A)[sP].[dR](C)[sP].[dR][C)[sP].[dR](T)[sP].[LR](G)[sP].[dR](C)[sP].[dR](T)[sP].[LR](G)[sP].[dR](C)[sP].[dR](A)[sP].[dR](G)[sP].[LR](A)[sP].[LR](G) | 1124 |

TABLE 12-continued

| Compound Table; compounds comprising modified nucleosides (SEQ ID NOs: 1011-1496). | | | | | |
|---|---|---|---|---|---|
| Motif SEQ ID | Motif Sequence | Target site sequence | Target SEQ | Compounds (HELM ANNOTATION) | SEQ ID NO. |
| | GCA<br>GAG | | | | |
| SEQ ID 122 | GCA<br>CCT<br>GCT<br>GCA<br>GAG<br>GTG | CACCTCTGCAGC AGGTGC | SEQ ID 413 | [LR](G)[sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[dR](C)[sP].[dR](A)[sP].[LR](G)[sP].[dR](A)[sP].[dR](G)[sP].[dR](G)[sP].[LR](T)[sP].[LR](G) | 1125 |
| SEQ ID 123 | CCT<br>GCT<br>GCA<br>GAG<br>GTG<br>CAC | GTGCACCTCTGC AGCAGG | SEQ ID 414 | [LR]([5meC])[sP].[dR](C)[sP].[dR](T)[sP].[LR](G)[sP].[dR](C)[sP].[dR](T)[sP].[LR](G)[sP].[dR](C)[sP].[dR][A)[sP].[dR](G)[sP].[LR](A)[sP].[dR](G)[sP].[dR](G)[sP].[dR](T)[sP].[LR](G)[sP].[dR](C)[sP].[LR](A)[sP].[LR]([5meC]) | 1126 |
| SEQ ID 124 | GCT<br>GCA<br>GAG<br>GTG<br>CAC<br>GTA | TACGTGCACCTCT GCAGC | SEQ ID 415 | [LR](G)[sP].[dR](C)[sP].[dR](T)[sP].[LR](G)[sP].[dR](C)[sP].[R](A)[sP].[dR](G)[sP].[LR](A)[sP].[dR](G)[sP].[dR][G)[sP].[dR](T)[sP].[LR](G)[sP].[dR](C)[sP].[LR](A)[sP].[dR]([5meC])[sP].[dR](G)[sP].[LR](T)[sP].[LR](A) | 1127 |
| SEQ ID 125 | GCA<br>GAG<br>GTG<br>CAC<br>GTA<br>GTC | GACTACGTGCAC CTCTGC | SEQ ID 416 | [LR](G)[sP].[dR](C)[sP].[dR](A)[sP].[dR][G)[sP].[LR](A)[sP].[dR](G)[sP].[dR](G)[sP].[dR](T)[sP].[LR](G)[sP].[dR](C)[sP].[dR](A)[sP].[dR](C)[sP].[LR](G)[sP].[dR](T)[sP].[dR](A)[sP].[dR](G)[sP].[LR](T)[sP].[LR]([5meC]) | 1128 |
| SEQ ID 126 | GAG<br>GTG<br>CAC<br>GTA<br>GTC<br>TGA | TCAGACTACGTG CACCTC | SEQ ID 417 | [LR](G)[sP].[dR](A)[sP].[dR](G)[sP].[LR](G)[sP].[dR](T)[sP].[dR](G)[sP].[dR](C)[sP].[LR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR](G)\|sP].[LR](A) | 1129 |
| SEQ ID 127 | GTG<br>CAC<br>GTA<br>GTC<br>TGA<br>GTG | CACTCAGACTAC GTGCAC | SEQ ID 418 | [LR](G)[sP].[dR](T)[sP].[dR](G)[sP].[dR](C)[sP].[LR](A)[sP].[dR](C)[sP].[LR](G)[sP].[dR](T)[sP].[dR](A)[sP].[dR][G)[sP].[LR](T)[sP].[dR](C)[sP].[dR](T)[sP].[LR](G)[sP].[dR](A)[sP].[dR](G)[sP].[LR](T)[sP].[LR](G) | 1130 |
| SEQ ID 128 | CAC<br>GTA<br>GTC | CAGCACTCAGAC TACGTG | SEQ ID 419 | [LR]([5meC])[sP].[dR](A)[sP].[dR](C)[sP].[LR][G][sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[LR] | 1131 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TGA GTG CTG | | | (T)[sP].[LR](G) | |
| SEQ ID 129 | GTA GTC TGA GTG CTG CGG | CCGCAGCACTCA GACTAC | SEQ ID 420 | [LR](G)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR](C)[sP].[LR](G)[sP].[LR](G) | 1132 |
| SEQ ID 130 | GTC TGA GTG CTG CGG ACT | AGTCCGCAGCAC TCAGAC | SEQ ID 421 | [LR](G)[sP].[dR](T)[sP].[dR][C)[sP].[dR](T)[sP].[LR](G)[sP].[dR](A)[sP].[dR](G)[sP].[dR](T)[sP].[LR](G)[sP].[dR](C)[sP].[dR](T)[sP].[dR](G)[sP].[LR]([5meC])[sP].[dR](G)[sP].[dR](G)[sP].[dR](A)[sP].[LR]([5meC])[sP].[LR](T) | 1133 |
| SEQ ID 131 | TGA GTG CTG CGG ACT CAG | CTGAGTCCGCAG CACTCA | SEQ ID 422 | [LR](T)[sP].[dR](G)[sP].[dR](A)[sP].[dR](G)[sP].[LR](T)[sP].[dR](G)[sP].[dR][C)[sP].[dR](T)[sP].[LR](G)[sP].[dR]([5meC])[sP].[dR](G)[sP].[dR](G)[sP].[LR](A)[sP].[dR][C][sP].[dR](T)[sP].[dR](C)[sP].[LR](A)[sP].[LR](G) | 1134 |
| SEQ ID 132 | GTG CTG CGG ACT CAG CAG | CTGCTGAGTCCG CAGCAC | SEQ ID 423 | [LR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[dR](G)[sP].[dR](C)[sP].[LR](A)[sP].[LR](G) | 1135 |
| SEQ ID 133 | CTG CGG ACT CAG CAG ACC | GGTCTGCTGAGT CCGCAG | SEQ ID 424 | [LR]([5meC])[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[dR](G)[sP].[dR](C)[sP].[LR](A)[sP].[dR](G)[sP].[dR](A)[sP].[LR]([5meC])[sP].[LR]([5meC]) | 1136 |
| SEQ ID 134 | CGG ACT CAG CAG ACC CGG | CCGGGTCTGCTG AGTCCG | SEQ ID 425 | [LR]([5meC])[sP].[dR](G)[sP].[dR](G)[sP].[LR](A)[sP].[dR](C)[sP].[dR](T)[sP].[dR](C)[sP].[LR](A)[sP].[dR][G)[sP].[dR](C)[sP].[LR](A)[sP].[dR][G)[sP].[LR](A)[sP].[dR](C)[sP].[dR](C)[sP].[dR](C)[sP].[LR](G)[sP].[LR](G) | 1137 |
| SEQ ID 135 | ACT CAG | TGGCCGGGTCTG CTGAGT | SEQ ID 426 | [LR](A)[sP].[dR](C)[sP].[dR](T)[sP].[dR][C)[sP].[LR](A)[sP].[dR](G)[sP].[dR](C)[sP].[dR](A)[sP].[LR](G)[sP].[dR](A)[sP].[dR](C)[sP].[dR] | 1138 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | CAG ACC CGG CCA | | | (C)[sP].[LR]([5meC])[sP].[dR](G)[sP].[dR](G)[sP].[dR](C)[sP].[LR]([5meC])[sP].[LR](A) | |
| SEQ ID 136 | CAG CAG ACC CGG CCA CCG | CGGTGGCCGGGTCTGCTG | SEQ ID 427 | [LR]([5meC])[sP].[dR](A)[sP].[dR](G)[sP].[dR](C)[sP].[LR](A)[sP].[dR](G)[sP].[LR](A)[sP].[dR](C)[sP].[dR](C)[sP].[dR](C)[sP].[LR](G)[sP].[dR](G)[sP].[dR](C)[sP].[dR](C)[sP].[LR](A)[sP].[dR](C)[sP].[LR]([5meC])[sP].[LR](G) | 1139 |
| SEQ ID 137 | CAG ACC CGG CCA CCG GCC | GGCCGGTGGCCGGGTCTG | SEQ ID 428 | [LR]([5meC])[sP].[dR](A)[sP].[dR](G)[sP].[LR](A)[sP].[dR](C)[sP].[dR](C)[sP].[dR](C)[sP].[LR](G)[sP].[dR][G][sP].[dR](C)[sP].[dR](C)[sP].[LR](A)[sP].[dR](C)[sP].[LR]([5meC])[sP].[dR](G)[sP].[dR](G)[sP].[LR]([5meC])[sP].[LR]([5meC]) | 1140 |
| SEQ ID 138 | ACC CGG CCA CCG GCC TTA | TAAGGCCGGTGGCCGGGT | SEQ ID 429 | [LR](A)[sP].[dR](C)[sP].[dR](C)[sP].[dR](C)[sP].[LR](G)[sP].[dR](G)[sP].[dR][C)[sP].[dR](C)[sP].[LR](A)[sP].[dR](C)[sP].[dR]([5meC])[sP].[dR](G)[sP].[LR](G)[sP].[dR](C)[sP].[dR](C)[sP].[dR](T)[sP].[LR](T)[sP].[LR](A) | 1141 |
| SEQ ID 139 | CGG CCA CCG GCC TTA CTC | GAGTAAGGCCGGTGGCCG | SEQ ID 430 | [LR]([5meC])[sP].[dR](G)[sP].[dR](G)[sP].[dR](C)[sP].[LR]([5meC])[sP].[dR](A)[sP].[dR](C)[sP].[dR](C)[sP].[LR](G)[sP].[dR](G)[sP].[dR](C)[sP].[dR](C)[sP].[LR](T)[sP].[dR](T)[sP].[dR][A][sP].[dR](C)[sP].[LR](T)[sP].[LR]([5meC]) | 1142 |
| SEQ ID 140 | CCA CCG GCC TTA CTC CAT | ATGGAGTAAGGCCGGTGG | SEQ ID 431 | [LR]([5meC])[sP].[dR](C)[sP].[LR](A)[sP].[dR](C)[sP].[dR](C)[sP].[LR](G)[sP].[dR](G)[sP].[dR](C)[sP].[dR](C)[sP].[LR](T)[sP].[dR](T)[sP].[dR](A)[sP].[dR](C)[sP].[LR](T)[sP].[dR](C)[sP].[dR](C)[sP].[LR](A)[sP].[LR](T) | 1143 |
| SEQ ID 141 | CCG GCC TTA CTC CAT TTC | GAAATGGAGTAAGGCCGG | SEQ ID 432 | [LR]([5meC])[sP].[dR]([5meC])[sP].[dR](G)[sP].[dR](G)[sP].[LR][5meC])[sP].[dR](C)[sP].[dR](T)[sP].[dR](T)[sP].[LR](A)[sP].[dR](C)[sP].[dR](T)[sP].[dR](C)[sP].[LR]([5meC])[sP].[dR](A)[sP].[dR](T)[sP].[dR](T)[sP].[LR](T)[sP].[LR]([5meC]) | 1144 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 142 | GCC TTA CTC CAT TTC CCT | AGGGAAATGGA GTAAGGC | SEQ ID 433 | [LR](G)[sP].[dR](C)[sP].[dR](C)[sP].[LR](T)[sP].[dR](T)[sP].[dR](A)[sP].[dR][C][sP].[LR](T)[sP].[dR](C)[sP].[dR](C)[sP].[LR](A)[sP].[dR](T)[sP].[LR](T)[sP].[dR](T)[sP].[dR](C)[sP].[dR](C)[sP].[LR]([5meC])[sP].[LR](T) | 1145 |
| SEQ ID 143 | TTA CTC CAT TTC CCT GGA | TCCAGGGAAATG GAGTAA | SEQ ID 434 | [LR](T)[sP].[dR](T)[sP].[dR](A)[sP].[dR](C)[sP].[LR](T)[sP].[dR](C)[sP].[dR](C)[sP].[LR](A)[sP].[dR](T)[sP].[LR](T)[sP].[dR](T)[sP].[dR](C)[sP].[LR]([5meC])[sP].[dR](C)[sP].[dR](T)[sP].[dR](G)[sP].[LR](G)[sP].[LR](A) | 1146 |
| SEQ ID 144 | CTC CAT TTC CCT GGA AGG | CCTTCCAGGGAA ATGGAG | SEQ ID 435 | [LR]([5meC])[sP].[dR](T)[sP].[dR](C)[sP].[dR](C)[sP].[LR](A)[sP].[dR](T)[sP].[dR](T)[sP].[dR](T)[sP].[LR]([5meC])[sP].[dR](C)[sP].[dR](C)[sP].[dR](T)[sP].[LR](G)[sP].[dR](G)[sP].[dR](A)[sP].[dR](A)[sP].[LR](G)[sP].[LR](G) | 1147 |
| SEQ ID 145 | CAT TTC CCT GGA AGG AAA | TTTCCTTCCAGGG AAATG | SEQ ID 436 | [LR]([5meC])[sP].[dR](A)[sP].[dR](T)[sP].[dR](T)[sP].[LR](T)[sP].[dR](C)[sP].[dR](C)[sP].[dR](C)[sP].[LR](T)[sP].[dR](G)[sP].[dR](G)[sP].[dR](A)[sP].[LR](A)[sP].[dR](G)[sP].[dR](G)[sP].[dR](A)[sP].[LR](A)[sP].[LR](A) | 1148 |
| SEQ ID 146 | TTC CCT GGA AGG AAA GAC | GTCTTTCCTTCCA GGGAA | SEQ ID 437 | [LR](T)[sP].[dR](T)[sP].[dR](C)[sP].[dR](C)[sP].[LR]([5meC])[sP].[dR](T)[sP].[dR](G)[sP].[dR](G)[sP].[LR](A)[sP].[dR](A)[sP].[dR](G)[sP].[dR](G)[sP].[LR](A)[sP].[dR](A)[sP].[dR](A)[sP].[dR][G][sP].[LR](A)[sP].[LR]([5meC]) | 1149 |
| SEQ ID 147 | CCT GGA AGG AAA GAC CAA | TTGGTCTTTCCTT CCAGG | SEQ ID 438 | [LR]([5meC])[sP].[dR](C)[sP].[dR](T)[sP].[LR](G)[sP].[dR](G)[sP].[dR](A)[sP].[LR](A)[sP].[dR](G)[sP].[dR](G)[sP].[dR](A)[sP].[LR](A)[sP].[dR](A)[sP].[LR](G)[sP].[dR](A)[sP].[dR](C)[sP].[dR](C)[sP].[LR](A)[sP].[LR](A) | 1150 |
| SEQ ID 148 | GGA AGG AAA GAC | ACTTTGGTCTTTC CTTCC | SEQ ID 439 | [LR](G)[sP].[dR](G)[sP].[LR][A)[sP].[dR](A)[sP].[dR](G)[sP].[LR](G)[sP].[dR](A)[sP].[dR](A)[sP].[LR](A)[sP].[dR](G)[sP].[dR](A)[sP].[dR](C)[sP].[LR]([5meC])[sP].[dR](A)[sP].[LR](A)[sP].[dR](A)[sP].[LR](G)[sP].[LR](T) | 1151 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | CAA AGT | | | | |
| SEQ ID 149 | AGG AAA GAC CAA AGT GAG | CTCACTTTGGTCT TTCCT | SEQ ID 440 | [LR](A)[sP].[dR](G)[sP].[dR](G)[sP].[LR](A)[sP].[dR](A)[sP].[LR](A)[sP].[dR](G)[sP].[LR](A)[sP].[dR][C)[sP].[dR](C)[sP].[LR][A][sP].[LR](A)[sP].[dR](A)[sP].[dR](G)[sP].[dR](T)[sP].[LR](G)[sP].[LR](A)[sP].[LR](G) | 1152 |
| SEQ ID 150 5 | AAA GAC CAA AGT GAG GGA | TCCCTCACTTTGG TCTTT | SEQ ID 441 | [LR](A)[sP].[dR](A)[sP].[LR](A)[sP].[dR](G)[sP].[dR](A)[sP].[dR](C)[sP].[LR]([5meC])[sP].[dR](A)[sP].[LR](A)[sP].[LR](A)[sP].[dR](G)[sP].[dR](T)[sP].[LR](G)[sP].[dR](A)[sP].[dR](G)[sP].[dR](G)[sP].[LR](G)[sP].[LR](A) | 1153 |
| SEQ ID 151 | GAC CAA AGT GAG GGA ACA | TGTTCCCTCACTT TGGTC | SEQ ID 442 | [LR](G)[sP].[dR](A)[sP].[dR](C)[sP].[dR](C)[sP].[LR](A)[sP].[LR](A)[sP].[dR](A)[sP].[dR](G)[sP].[dR](T)[sP].[LR](G)[sP].[dR](A)[sP].[dR](G)[sP].[dR](G)[sP].[LR](G)[sP].[dR](A)[sP].[dR](A)[sP].[LR]([5meC])[sP].[LR](A) | 1154 |
| SEQ ID 152 | CAA AGT GAG GGA ACA CTC | GAGTGTTCCCTC ACTTTG | SEQ ID 443 | [LR]([5meC])[sP].[dR](A)[sP].[LR](A)[sP].[dR](A)[sP].[dR](G)[sP].[dR](T)[sP].[LR](G)[sP].[dR](A)[sP].[LR](G)[sP].[dR](G)[sP].[LR](G)[sP].[dR](A)[sP].[LR](A)[sP].[dR](C)[sP].[LR](A)[sP].[dR](C)[sP].[LR](T)[sP].[LR]([5meC]) | 1155 |
| SEQ ID 153 | AGT GAG GGA ACA CTC CAA | TTGGAGTGTTCC CTCACT | SEQ ID 444 | [LR](A)[sP].[dR](G)[sP].[dR](T)[sP].[LR](G)[sP].[dR](A)[sP].[dR](G)[sP].[dR](G)[sP].[LR](G)[sP].[dR](A)[sP].[dR](A)[sP].[dR](C)[sP].[LR](A)[sP].[dR](C)[sP].[LR](T)[sP].[dR](C)[sP].[dR](C)[sP].[LR](A)[sP].[LR](A) | 1156 |
| SEQ ID 154 | GAG GGA ACA CTC CAA GGA | TCCTTGGAGTGTT CCCTC | SEQ ID 445 | [LR](G)[sP].[dR](A)[sP].[dR](G)[sP].[dR](G)[sP].[LR](G)[sP].[R](A)[sP].[dR](A)[sP].[dR](C)[sP].[LR](A)[sP].[dR](C)[sP].[dR](T)[sP].[dR](C)[sP].[LR]([5meC])[sP].[dR](A)[sP].[dR](A)[sP].[dR](G)[sP].[LR](G)[sP].[LR](A) | 1157 |
| SEQ ID 155 | GGA ACA CTC | ATTTCCTTGGAGT GTTCC | SEQ ID 446 | [LR](G)[sP].[dR](G)[sP].[dR](A)[sP].[LR](A)[sP].[dR](C)[sP].[LR](A)[sP].[dR](C)[sP].[LR](T)[sP].[dR](C)[sP].[dR](C)[sP].[LR](A)[sP].[LR](A)[sP].[dR](G)[sP].[dR](G)[sP].[LR](A)[sP].[dR](A)[sP].[LR](A)[sP]. | 1158 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CAA GGA AAT | | | [LR](T) | |
| SEQ ID 156 | ACA CTC CAA GGA AAT GCA | TGCATTTCCTTGG AGTGT | SEQ ID 447 | [LR](A)[sP].[dR](C)[sP].[dR](A)[sP].[dR](C)[sP].[LR](T)[sP].[dR](C)[sP].[dR](C)[sP].[LR](A)[sP].[dR](A)[sP].[dR](G)[sP].[dR](G)[sP].[LR](A)[sP].[dR](A)[sP].[LR](A)[sP].[dR](T)[sP].[dR](G)[sP].[LR]([5meC])[sP].[LR](A) | 1159 |
| SEQ ID 157 | CTC CAA GGA AAT GCA CAC | GTGTGCATTTCCT TGGAG | SEQ ID 448 | [LR]([5meC])[sP].[dR](T)[sP].[dR](C)[sP].[dR](C)[sP].[LR](A)[sP].[dR](A)[sP].[dR](G)[sP].[LR](G)[sP].[dR](A)[sP].[LR](A)[sP].[dR](A)[sP].[dR](T)[sP].[dR](G)[sP].[LR]([5meC])[sP].[dR](A)[sP].[dR](C)[sP].[LR](A)[sP].[LR]([5meC]) | 1160 |
| SEQ ID 158 | CAA GGA AAT GCA CAC CAG | CTGGTGTGCATTT CCTTG | SEQ ID 449 | [LR]([5meC])[sP].[dR](A)[sP].[dR][A][sP].[dR](G)[sP].[LR](G)[sP].[dR](A)[sP].[LR](A)[sP].[LR](A)[sP].[dR](T)[sP].[LR](G)[sP].[dR](C)[sP].[LR](A)[sP].[dR](C)[sP].[LR](A)[sP].[dR](C)[sP].[dR](C)[sP].[LR](A)[sP].[LR](G) | 1161 |
| SEQ ID 159 | GGA AAT GCA CAC CAG GCT | AGCCTGGTGTGC ATTTCC | SEQ ID 450 | [LR](G)[sP].[dR](G)[sP].[dR](A)[sP].[dR](A)[&P].[LR](A)[sP].[dR](T)[sP].[dR][G][sP].[dR](C)[sP].[LR](A)[sP].[dR](C)[sP].[dR](A)[sP].[dR](C)[sP].[LR]([5meC])[sP].[dR](A)[sP].[dR](G)[sP].[dR](G)[sP].[LR]([5meC])[sP].[LR](T) | 1162 |
| SEQ ID 160 | AAT GCA CAC CAG GCT ATG | CATAGCCTGGTG TGCATT | SEQ ID 451 | [LR](A)[sP].[dR](A)[sP].[dR](T)[sP].[LR](G)[sP].[dR](C)[sP].[dR](A)[sP].[dR](C)[sP].[LR](A)[sP].[dR](C)[sP].[dR](C)[sP].[LR](A)[sP].[dR](G)[sP].[LR](G)[sP].[dR](C)[sP].[dR](T)[sP].[dR](A)[sP].[LR](T)[sP].[LR](G) | 1163 |
| SEQ ID 161 | GCA CAC CAG GCT ATG GGA | TCCCATAGCCTG GTGTGC | SEQ ID 452 | [LR](G)[sP].[dR](C)[sP].[dR](A)[sP].[dR](C)[sP].[LR](A)[sP].[dR](C)[sP].[dR](C)[sP].[dR](A)[sP].[LR](G)[sP].[dR][G][sP].[dR](C)[sP].[dR](T)[sP].[LR](A)[sP].[dR](T)[sP].[dR](G)[sP].[dR](G)[sP].[LR](G)[sP].[LR](A) | 1164 |
| SEQ ID 162 | CAC CAG | ACCTCCCATAGCC TGGTG | SEQ ID 453 | [LR]([5meC])[sP].[dR](A)[sP].[dR](C)[sP].[dR](C)[sP].[LR](A)[sP].[dR](G)[sP].[LR](G)[sP].[dR][C)[sP].[dR](T)[sP].[LR](A)[sP].[dR](T)[sP]. | 1165 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | GCT ATG GGA GGT | | | [dR](G)[sP].[dR](G)[sP].[LR](G)[sP].[dR](A)[sP].[dR](G)[sP].[LR](G)[sP].[LR](T) | |
| SEQ ID 163 | CAG GCT ATG GGA GGT GGC | GCCACCTCCCATAGCCTG | SEQ ID 454 | [LR]([5meC])[sP].[dR](A)[sP].[dR](G)[sP].[LR](G)[sP].[dR](C)[sP].[dR](T)[sP].[LR](A)[sP].[dR](T)[sP].[dR][G][sP].[dR](G)[sP].[LR](G)[sP].[dR](A)[sP].[dR](G)[sP].[LR](G)[sP].[dR](T)[sP].[dR](G)[sP].[LR](G)[sP].[LR]([5meC] | 1166 |
| SEQ ID 164 | GCT ATG GGA GGT GGC TCA | TGAGCCACCTCCCATAGC | SEQ ID 455 | [LR](G)[sP].[dR](C)[sP].[dR](T)[sP].[LR](A)[sP].[dR](T)[sP].[dR](G)[sP].[dR](G)[sP].[LR](G)[sP].[dR](A)[sP].[dR](G)[sP].[LR](G)[sP].[dR](T)[sP].[LR](G)[sP].[dR](G)[sP].[dR](C)[sP].[dR](T)[sP].[LR]([5meC])[sP].[LR](A) | 1167 |
| SEQ ID 165 | ATG GGA GGT GGC TCA GAG | CTCTGAGCCACCTCCCAT | SEQ ID 456 | [LR](A)[sP].[dR](T)[sP].[dR](G)[sP].[dR](G)[sP].[LR][G][sP].[dR](A)[sP].[dR](G)[sP].[dR](G)[sP].[LR](T)[sP].[dR][G][sP].[dR](G)[sP].[dR](C)[sP].[LR](T)[sP].[dR](C)[sP].[dR](A)[sP].[dR](G)[sP].[LR](A)[sP].[LR](G) | 1168 |
| SEQ ID 166 | GGA GGT GGC TCA GAG CAT | ATGCTCTGAGCCACCTCC | SEQ ID 457 | [LR](G)[sP].[dR](G)[sP].[dR](A)[sP].[dR](G)[sP].[LR](G)[sP].[dR](T)[sP].[dR](G)[sP].[dR](G)[sP].[LR]([5meC])[sP].[dR](T)[sP].[dR](C)[sP].[dR](A)[sP].[LR](G)[sP].[dR](A)[sP].[dR](G)[sP].[dR](C)[sP].[LR](A)[sP].[LR](T) | 1169 |
| SEQ ID 167 | GGT GGC TCA GAG CAT AAG | CTTATGCTCTGAGCCACC | SEQ ID 458 | [LR](G)[sP].[dR](G)[sP].[dR](T)[sP].[LR](G)[sP].[dR](G)[sP].[dR](C)[sP].[LR](T)[sP].[dR](C)[sP].[dR](A)[sP].[LR](G)[sP].[dR](A)[sP].[dR](G)[sP].[dR](C)[sP].[LR](A)[sP].[dR](T)[sP].[dR](A)[sP].[LR](A)[sP].[LR](G) | 1170 |
| SEQ ID 168 | GGC TCA GAG CAT AAG CCT | AGGCTTATGCTCTGAGCC | SEQ ID 459 | [LR](G)[sP].[dR](G)[sP].[dR](C)[sP].[LR](T)[sP].[dR](C)[sP].[dR](A)[sP].[LR](G)[sP].[dR](A)[sP].[dR](G)[sP].[dR](C)[sP].[LR](A)[sP].[dR](T)[sP].[LR](A)[sP].[dR](A)[sP].[dR](G)[sP].[dR](C)[sP].[LR]([5meC])[sP].[LR](T) | 1171 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 169 | TCA GAG CAT AAG CCT GCT | AGCAGGCTTATG CTCTGA | SEQ ID 460 | [LR](T)[sP].[dR](C)[sP].[dR](A)[sP].[LR](G)[sP].[dR](A)[sP].[dR](G)[sP].[dR][C)[sP].[LR](A)[sP].[dR](T)[sP].[LR](A)[sP].[dR](A)[sP].[dR](G)[sP].[dR](C)[sP].[LR]([5meC])[sP].[dR](T)[sP].[dR](G)[sP].[LR]([5meC])[sP].[LR](T) | 1172 |
| SEQ ID 170 | GAG CAT AAG CCT GCT TGT | ACAAGCAGGCTT ATGCTC | SEQ ID 461 | [LR](G)[sP].[dR](A)[sP].[dR][G)[sP].[dR](C)[sP].[LR](A)[sP].[dR](T)[sP].[dR](A)[sP].[dR](A)[sP].[LR](G)[sP].[dR](C)[sP].[dR](C)[sP].[dR](T)[sP].[LR](G)[sP].[dR](C)[sP].[dR](T)[sP].[dR](T)[sP].[LR](G)[sP].[LR](T) | 1173 |
| SEQ ID 171 | CAT AAG CCT GCT TGT TAG | CTAACAAGCAGG CTTATG | SEQ ID 462 | [LR]([5meC])[sP].[dR](A)[sP].[dR](T)[sP].[LR](A)[sP].[dR](A)[sP].[dR](G)[sP].[dR](C)[sP].[LR]([5meC])[sP].[dR](T)[sP].[LR](G)[sP].[dR](C)[sP].[dR](T)[sP].[dR](T)[sP].[LR](G)[sP].[dR](T)[sP].[dR](T)[sP].[LR](A)[sP].[LR](G) | 1174 |
| SEQ ID 172 | AAG CCT GCT TGT TAG GCA | TGCCTAACAAGC AGGCTT | SEQ ID 463 | [LR](A)[sP].[dR](A)[sP].[dR](G)[sP].[dR](C)[sP].[LR]([5meC])[sP].[dR](T)[sP].[LR](G)[sP].[dR](C)[sP].[dR](T)[sP].[dR](T)[sP].[LR](G)[sP].[dR](T)[sP].[dR](T)[sP].[LR](A)[sP].[dR](G)[sP].[dR](G)[sP].[LR]([5meC])[sP].[LR](A) | 1175 |
| SEQ ID 173 | CCT GCT TGT TAG GCA AGC | GCTTGCCTAACA AGCAGG | SEQ ID 464 | [LR]([5meC])[sP].[dR](C)[sP].[dR](T)[sP].[LR](G)[sP].[dR](C)[sP].[dR](T)[sP].[dR](T)[sP].[LR](G)[sP].[dR](T)[sP].[dR](T)[sP].[LR](A)[sP].[dR](G)[sP].[dR](G)[sP].[dR][C)[sP].[LR](A)[sP].[dR](A)[sP].[LR](G)[sP].[LR]([5meC]) | 1176 |
| SEQ ID 174 | GCT TGT TAG GCA AGC ATC | GATGCTTGCCTA ACAAGC | SEQ ID 465 | [LR](G)[sP].[dR](C)[sP].[dR](T)[sP].[dR](T)[sP].[LR](G)[sP].[dR](T)[sP].[dR](T)[sP].[LR](A)[sP].[dR](G)[sP].[dR](G)[sP].[dR](C)[sP].[LR](A)[sP].[dR](A)[sP].[dR](G)[sP].[dR][C)[sP].[LR](A)[sP].[LR](T)[sP].[LR]([5meC]) | 1177 |
| SEQ ID 175 | TGT TAG GCA AGC | ATTGATGCTTGCC TAACA | SEQ ID 466 | [LR](T)[sP].[dR](G)[sP].[LR](T)[sP].[dR](T)[sP].[dR](A)[sP].[dR](G)[sP].[LR](G)[sP].[dR](C)[sP].[LR](A)[sP].[dR](A)[sP].[dR](G)[sP].[dR](C)[sP].[LR](A)[&P].[dR](T)[sP].[dR](C)[sP].[LR](A)[sP].[LR](A)[sP].[LR](T) | 1178 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | ATC AAT | | | | |
| SEQ ID 176 | TAG GCA AGC ATC AAT GTA | TACATTGATGCTT GCCTA | SEQ ID 467 | [LR](T)[sP].[dR](A)[sP].[dR](G)[sP].[dR](G)[sP].[LR]([5meC])[sP].[dR](A)[sP].[dR](A)[sP].[dR](G)[sP].[LR]([5meC])[sP].[dR](A)[sP].[dR](T)[sP].[dR](C)[sP].[LR](A)[sP].[dR][A][sP].[dR](T)[sP].[dR](G)[sP].[LR](T)[sP].[LR](A) | 1179 |
| SEQ ID 177 | GCA AGC ATC AAT GTA AAA | TTTTACATTGATG CTTGC | SEQ ID 468 | [LR](G)[sP].[LR]([5meC])[sP].[dR](A)[sP].[LR](A)[sP].[dR][G)[sP].[dR](C)[sP].[dR](A)[sP].[LR](T)[sP].[dR][C)[sP].[dR](A)[sP].[dR](A)[sP].[LR](T)[sP].[LR](G)[sP].[dR](T)[sP].[dR](A)[sP].[LR](A)[sP].[LR](A)[sP].[LR](A) | 1180 |
| SEQ ID 178 | AGC ATC AAT GTA AAA TTT | AAATTTTACATTG ATGCT | SEQ ID 469 | [LR](A)[sP].[dR](G)[sP].[LR]([5meC])[sP].[LR](A)[sP].[dR](T)[sP].[LR]([5meC])[sP].[dR](A)[sP].[dR](A)[sP].[LR](T)[sP].[dR](G)[sP].[LR](T)[sP].[LR](A)[sP].[dR](A)[sP].[LR](A)[sP].[dR](A)[sP].[LR](T)[sP].[LR](T)[sP].[LR](T) | 1181 |
| SEQ ID 179 | ATC AAT GTA AAA TTT GGA | TCCAAATTTTACA TTGAT | SEQ ID 470 | [LR](A)[sP].[LR](T)[sP].[dR][C)[sP].[dR](A)[sP][LR](A)[sP].[dR](T)[sP].[LR](G)[sP].[LR](T)[sP].[dR](A)[sP].[LR](A)[sP].[dR](A)[sP].[LR](A)[sP].[LR](T)[sP].[dR](T)[sP].[dR](T)[sP].[LR](G)[sP].[LR](G)[sP].[LR](A) | 1182 |
| SEQ ID 180 | AAT GTA AAA TTT GGA GCA | TGCTCCAAATTTT ACATT | SEQ ID 471 | [LR](A)[sP].[dR](A)[sP].[dR](T)[sP].[dR][G][sP].[LR](T)[sP].[dR](A)[sP].[LR](A)[sP].[LR](A)[sP].[dR](A)[sP].[dR](T)[sP].[LR](T)[sP].[LR](T)[sP].[dR](G)[sP].[dR](G)[sP].[dR](A)[sP].[LR](G)[sP].[LR]([5meC])[sP].[LR](A) | 1183 |
| SEQ ID 181 | GTA AAA TTT GGA GCA TGA | TCATGCTCCAAAT TTTAC | SEQ ID 472 | [LR](G)[sP].[dR](T)[sP].[LR](A)[sP].[dR](A)[sP].[dR](A)[sP].[dR](A)[sP].[LR](T)[sP].[LR](T)[sP].[dR](T)[sP].[LR](G)[sP].[dR](G)[sP].[dR](A)[sP].[LR](G)[sP].[dR](C)[sP].[dR](A)[sP].[LR](T)[sP].[LR](G)[sP].[LR](A) | 1184 |
| SEQ ID 182 | AAA TTT GGA | CTGTCATGCTCCA AATTT | SEQ ID 473 | [LR](A)[sP].[LR](A)[sP].[dR](A)[sP].[dR](T)[sP].[dR](T)[sP].[LR](T)[sP].[dR](G)[sP].[dR](G)[sP].[dR](A)[sP].[LR](G)[sP].[dR](C)[sP].[LR](A)[sP].[dR](T)[sP].[LR](G)[sP].[dR](A)[sP].[LR]([5meC])[sP].[LR] | 1185 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | GCA TGA CAG | | | (A)[sP].[LR](G) | |
| SEQ ID 183 | TTT GGA GCA TGA CAG TTG | CAACTGTCATGCT CCAAA | SEQ ID 474 | [LR](T)[sP].[dR](T)[sP].[dR](T)[sP].[dR](G)[sP].[LR](G)[sP].[dR](A)[sP].[dR][G][sP].[dR][C)[sP].[LR](A)[sP].[dR](T)[sP].[LR](G)[sP].[dR](A)[sP].[dR](C)[sP].[dR](A)[sP].[LR](G)[sP].[dR](T)[sP].[LR](T)[sP].[LR](G) | 1186 |
| SEQ ID 184 | GGA GCA TGA CAG TTG TGC | GCACAACTGTCA TGCTCC | SEQ ID 475 | [LR](G)[sP].[dR](G)[sP].[dR](A)[sP].[dR](G)[sP].[LR]([5meC])[sP].[dR](A)[sP].[dR](T)[sP].[LR](G)[sP].[dR](A)[sP].[dR](C)[sP].[LR](A)[sP].[dR](G)[sP].[dR](T)[sP].[dR](T)[sP].[LR](G)[sP].[dR](T)[sP].[LR](G)[sP].[LR]([5meC]) | 1187 |
| SEQ ID 185 | GCA TGA CAG TTG TGC CTG | CAGGCACAACTG TCATGC | SEQ ID 476 | [LR](G)[sP].[dR](C)[sP].[dR](A)[sP].[dR](T)[sP].[LR](G)[sP].[dR](A)[sP].[dR](C)[sP].[LR](A)[sP].[dR](G)[sP].[dR](T)[sP].[dR](T)[sP].[LR](G)[sP].[dR](T)[sP].[LR](G)[sP].[dR](C)[sP].[dR](C)[sP].[LR](T)[sP].[LR](G) | 1188 |
| SEQ ID 186 | TGA CAG TTG TGC CTG TAT | ATACAGGCACAA CTGTCA | SEQ ID 477 | [LR](T)[sP].[dR](G)[sP].[dR][A][sP].[dR](C)[sP].[LR](A)[sP].[dR](G)[sP].[dR](T)[sP].[dR](T)[sP].[LR](G)[sP].[dR](T)[sP].[LR](G)[sP].[dR](C)[sP].[dR](C)[sP].[dR](T)[sP].[LR](G)[sP].[dR](T)[sP].[LR](A)[sP].[LR](T) | 1189 |
| SEQ ID 187 | CAG TTG TGC CTG TAT AAC | GTTATACAGGCA CAACTG | SEQ ID 478 | [LR]([5meC])[sP].[dR](A)[sP].[dR](G)[sP].[LR](T)[sP].[dR](T)[sP].[dR](G)[sP].[dR](T)[sP].[LR](G)[sP].[dR](C)[sP].[dR](C)[sP].[dR](T)[sP].[LR](G)[sP].[dR](T)[sP].[LR][A)[sP].[dR](T)[sP].[dR](A)[sP].[LR](A)[sP].[LR]([5meC]) | 1190 |
| SEQ ID 188 | TTG TGC CTG TAT AAC CCC | GGGGTTATACAG GCACAA | SEQ ID 479 | [LR](T)[sP].[dR](T)[sP].[dR](G)[sP].[dR](T)[sP].[LR](G)[sP].[dR](C)[sP].[dR](C)[sP].[dR](T)[sP].[LR](G)[sP].[dR](T)[sP].[dR](A)[sP].[dR](T)[sP].[LR](A)[sP].[dR](A)[sP].[dR](C)[sP].[dR](C)[sP].[LR]([5meC])[sP].[LR]([5meC]) | 1191 |
| SEQ ID 189 | TGC CTG | GTTGGGGTTATA CAGGCA | SEQ ID 480 | [LR](T)[sP].[dR](G)[sP].[dR](C)[sP].[LR]([5meC])[sP].[dR](T)[sP].[dR](G)[sP].[dR](T)[sP].[LR](A)[sP].[dR](T)[sP].[LR](A)[sP].[dR](A)[sP]. | 1192 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TAT AAC CCC AAC | | | [dR](C)[sP].[LR]([5meC])[sP].[dR](C)[sP].[dR](C)[sP].[dR](A)[sP].[LR](A)[sP].[LR]([5meC]) | |
| SEQ ID 190 | CTG TAT AAC CCC AAC ACT | AGTGTTGGGGTTATACAG | SEQ ID 481 | [LR]([5meC])[sP].[dR](T)[sP].[dR](G)[sP].[dR](T)[sP].[LR](A)[sP].[dR](T)[sP].[dR](A)[sP].[dR](A)[sP].[LR]([5meC])[sP].[dR](C)[sP].[dR](C)[sP].[dR](C)[sP].[LR](A)[sP].[dR](A)[sP].[dR](C)[sP].[dR](A)[sP].[LR]([5meC])[sP].[LR](T) | 1193 |
| SEQ ID 191 | TAT AAC CCC AAC ACT GAG | CTCAGTGTTGGGGTTATA | SEQ ID 482 | [LR](T)[sP].[dR](A)[sP].[dR](T)[sP].[LR](A)[sP].[dR](A)[sP].[dR](C)[sP].[LR]([5meC])[sP].[dR](C)[sP].[dR](C)[sP].[LR](A)[sP].[dR](A)[sP].[dR](C)[sP].[LR](A)[sP].[dR](C)[sP].[dR](T)[sP].[dR](G)[sP].[LR](A)[sP].[LR](G) | 1194 |
| SEQ ID 192 | AAC CCC AAC ACT GAG GGA | TCCCTCAGTGTTGGGGTT | SEQ ID 483 | [LR](A)[sP].[dR](A)[sP].[dR](C)[sP].[LR]([5meC])[sP].[dR](C)[sP].[dR](C)[sP].[LR](A)[sP].[dR](A)[sP].[dR](C)[sP].[LR](A)[sP].[dR](C)[sP].[dR](T)[sP].[LR](G)[sP].[dR](A)[sP].[dR](G)[sP].[dR](G)[sP].[LR](G)[sP].[LR](A) | 1195 |
| SEQ ID 193 | CAA GCT CTA CCT CGG AGT | ACTCCGAGGTAGAGCTTG | SEQ ID 484 | [LR]([5meC])[sP].[dR](A)[sP].[dR][A)[sP].[dR](G)[sP].[LR]([5meC])[sP].[dR](T)[sP].[dR](C)[sP].[dR](T)[sP].[LR](A)[sP].[dR](C)[sP].[dR](C)[sP].[dR](T)[sP].[LR]([5meC])[sP].[dR](G)[sP].[dR](G)[sP].[dR](A)[sP].[LR](G)[sP].[LR](T) | 1196 |
| SEQ ID 194 | AAG CTC TAC CTC GGA GTC | GACTCCGAGGTAGAGCTT | SEQ ID 485 | [LR](A)[sP].[dR](A)[sP].[dR](G)[sP].[dR](C)[sP].[LR](T)[sP].[dR](C)[sP].[dR](T)[sP].[LR](A)[sP].[dR](C)[sP].[dR](C)[sP].[LR](T)[sP].[dR]([5meC])[sP].[dR](G)[sP].[LR](G)[sP].[dR](A)[sP].[dR](G)[sP].[LR](T)[sP].[LR]([5meC]) | 1197 |
| SEQ ID 195 | GCT CTA CCT CGG AGT CTG | CAGACTCCGAGGTAGAGC | SEQ ID 486 | [LR](G)[sP].[dR](C)[sP].[LR](T)[sP].[dR](C)[sP].[dR](T)[sP].[LR](A)[sP].[dR](C)[sP].[dR](C)[sP].[LR](T)[sP].[dR]([5meC])[sP].[dR](G)[sP].[dR](G)[sP].[LR](A)[sP].[dR](G)[sP].[dR](T)[sP].[dR](C)[sP].[LR](T)[sP].[LR](G) | 1198 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 196 | CTC TAC CTC GGA GTC TGA | TCAGACTCCGAG GTAGAG | SEQ ID 487 | [LR]([5meC])[sP].[dR](T)[sP].[dR](C)[sP].[dR](T)[sP].[LR](A)[sP].[dR](C)[sP].[dR](C)[sP].[dR](T)[sP].[LR]([5meC])[sP].[dR](G)[sP].[dR](G)[sP].[dR](A)[sP].[LR](G)[sP].[dR](T)[sP].[dR](C)[sP].[dR](T)[sP].[LR](G)[sP].[R](A) | 1199 |
| SEQ ID 197 | CTA CCT CGG AGT CTG AAG | CTTCAGACTCCGA GGTAG | SEQ ID 488 | [LR]([5meC])[sP].[dR](T)[sP].[LR](A)[sP].[dR](C)[sP].[dR](C)[sP].[dR](T)[sP].[LR]([5meC])[sP].[dR][G)[sP].[dR](G)[sP].[dR](A)[sP].[LR](G)[sP].[dR](T)[sP].[dR](C)[sP].[dR](T)[sP].[LR](G)[sP].[dR](A)[sP].[LR](A)[sP].[LR](G) | 1200 |
| SEQ ID 198 | TAC CTC GGA GTC TGA AGA | TCTTCAGACTCCG AGGTA | SEQ ID 489 | [LR](T)[sP].[dR](A)[sP].[dR][C)[sP].[dR](C)[sP].[LR](T)[sP].[dR]([5meC])[sP].[dR](G)[sP].[LR](G)[sP].[dR](A)[sP].[dR](G)[sP].[LR](T)[sP].[dR](C)[sP].[dR](T)[sP].[LR](G)[sP].[dR](A)[sP].[dR](A)[sP].[LR](G)[sP].[R](A) | 1201 |
| SEQ ID 199 | CCT CGG AGT CTG AAG AGT | ACTCTTCAGACTC CGAGG | SEQ ID 490 | [LR]([5meC])[sP].[dR](C)[sP].[dR](T)[sP].[dR](C)[sP].[LR](G)[sP].[dR](G)[sP].[dR](A)[sP].[dR](G)[sP].[LR](T)[sP].[dR](C)[sP].[dR](T)[sP].[dR](G)[sP].[LR](A)[sP].[dR](A)[sP].[dR](G)[sP].[dR](A)[sP].[LR](G)[sP].[LR](T) | 1202 |
| SEQ ID 200 | CTC GGA GTC TGA AGA GTC | GACTCTTCAGACT CCGAG | SEQ ID 491 | [LR]([5meC])[sP].[dR](T)[sP].[dR]([5meC])[sP].[dR][G)[sP].[LR](G)[sP].[dR](A)[sP].[dR](G)[sP].[LR](T)[sP].[dR](C)[sP].[dR](T)[sP].[LR](G)[sP].[dR](A)[sP].[dR](A)[sP].[LR](G)[sP].[dR](A)[sP].[dR](G)[sP].[LR](T)[sP].[LR]([5meC]) | 1203 |
| SEQ ID 201 | CGG AGT CTG AAG AGT CAA | TTGACTCTTCAGA CTCCG | SEQ ID 492 | [LR]([5meC])[sP].[dR](G)[sP].[LR](G)[sP].[dR](A)[sP].[LR](G)[sP].[dR](T)[sP].[dR](C)[sP].[dR](T)[sP].[LR](G)[sP].[dR](A)[sP].[dR](A)[sP].[dR](G)[sP].[LR](A)[sP].[dR](G)[sP].[dR](T)[sP].[dR](C)[sP].[LR](A)[sP].[LR](A) | 1204 |
| SEQ ID 202 | GGA GTC TGA AGA | GTTGACTCTTCAG ACTCC | SEQ ID 493 | [LR](G)[sP].[dR](G)[sP].[dR](A)[sP].[dR](G)[sP].[LR](T)[sP].[dR](C)[sP].[dR](T)[sP].[LR](G)[sP].[dR](A)[sP].[dR](A)[sP].[LR](G)[sP].[dR](A)[sP].[dR](G)[sP].[LR](T)[sP].[dR](C)[sP].[dR](A)[sP].[LR](A)[sP].[LR]([5meC]) | 1205 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | GTC AAC | | | | |
| SEQ ID 203 | AGT CTG AAG AGT CAA CAG | CTGTTGACTCTTC AGACT | SEQ ID 494 | [LR](A)[sP].[LR](G)[sP].[dR](T)[sP].[dR](C)[sP].[dR](T)[sP].[LR](G)[sP].[dR](A)[sP].[LR](A)[sP].[dR](G)[sP].[dR](A)[sP].[dR](G)[sP].[LR](T)[sP].[dR](C)[sP].[LR](A)[sP].[dR](A)[sP].[dR](C)[sP].[LR](A)[sP].[LR](G) | 1206 |
| SEQ ID 204 | GTC TGA AGA GTC AAC AGT | ACTGTTGACTCTT CAGAC | SEQ ID 495 | [LR](G)[sP].[dR](T)[sP].[dR][C)[sP].[dR](T)[sP].[LR][G)[sP].[dR](A)[sP].[dR](A)[sP].[LR](G)[sP].[dR](A)[sP].[dR](G)[sP].[LR](T)[sP].[dR](C)[sP].[LR](A)[sP].[dR](A)[sP].[dR](C)[sP].[dR](A)[sP].[LR](G)[sP].([LR](T) | 1207 |
| SEQ ID 205 | CTG AAG AGT CAA CAG TGT | ACACTGTTGACTC TTCAG | SEQ ID 496 | [LR]([5meC][sP].[dR](T)[sP].[dR][G)[sP].[dR](A)[sP].[LR](A)[sP].[dR](G)[sP].[dR](A)[sP].[LR](G)[sP].[dR](T)[sP].[dR](C)[sP].[LR](A)[sP].[dR](A)[sP].[dR](C)[sP].[LR](A)[sP].[dR](G)[sP].[dR](T)[sP].[LR](G)[sP].[LR](T) | 1208 |
| SEQ ID 206 | TGA AGA GTC AAC AGT GTC | GACACTGTTGAC TCTTCA | SEQ ID 497 | [LR](T)[sP].[dR][G)[sP].[dR](A)[sP].[dR](A)[sP].[LR](G)[sP].[dR](A)[sP].[LR](G)[sP].[dR](T)[sP].[LR]([5meC])[sP].[dR](A)[sP].[dR](A)[sP].[dR](C)[sP].[LR](A)[sP].[dR](G)[sP].[dR](T)[sP].[dR](G)[sP].[LR](T)[sP].[LR]([5meC]) | 1209 |
| SEQ ID 207 | AAG AGT CAA CAG TGT CAG | CTGACACTGTTG ACTCTT | SEQ ID 498 | [LR](A)[sP].[dR](A)[sP].[dR](G)[sP].[LR](A)[sP].[dR](G)[sP].[dR](T)[sP].[dR](C)[sP].[LR][A)[sP].[LR](A)[sP].[dR][C)[sP].[dR][A)[sP].[LR](G)[sP].[dR](T)[sP].[dR](G)[sP].[LR](T)[sP].[dR](C)[sP].[LR](A)[sP].[LR](G) | 1210 |
| SEQ ID 208 | AGA GTC AAC AGT GTC AGA | TCTGACACTGTTG ACTCT | SEQ ID 499 | [LR](A)[sP].[dR](G)[sP].[dR](A)[sP].[dR](G)[sP].[LR](T)[sP].[dR](C)[sP].[LR](A)[sP].[dR](A)[sP].[dR][C)[sP].[LR](A)[sP].[dR](G)[sP].[dR](T)[sP].[LR](G)[sP].[dR](T)[sP].[dR](C)[sP].[dR](A)[sP].[LR](G)[sP].[LR](A) | 1211 |
| SEQ ID 209 | AGT CAA CAG | ATTCTGACACTGT TGACT | SEQ ID 500 | [LR](A)[sP].[dR](G)[sP].[dR](T)[sP].[LR]([5meC])[sP].[dR](A)[sP].[LR](A)[sP].[dR](C)[sP].[LR](A)[sP].[dR](G)[sP].[dR](T)[sP].[dR](G)[sP].[LR](T)[sP].[dR](C)[sP].[dR](A)[sP].[dR](G)[sP].[LR](A)[sP].[LR] | 1212 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | TGT CAG AAT | | | (A)[sP].[LR](T) | |
| SEQ ID 210 | GTC AAC AGT GTC AGA ATC | GATTCTGACACT GTTGAC | SEQ ID 501 | [LR](G)[sP].[dR](T)[sP].[dR](C)[sP].[LR](A)[sP].[LR](A)[sP].[dR](C)[sP].[dR](A)[sP].[dR](G)[sP].[LR](T)[sP].[dR](G)[sP].[dR](T)[sP].[dR](C)[sP].[LR](A)[sP].[dR](G)[sP].[LR](A)[sP].[dR](A)[sP].[LR](T)[sP].[LR]([5meC]) | 1213 |
| SEQ ID 211 | CAA CAG TGT CAG AAT CCA | TGGATTCTGACA CTGTTG | SEQ ID 502 | [LR]([5meC])[sP].[dR](A)[sP].[dR](A)[sP].[dR](C)[sP].[LR](A)[sP].[dR](G)[sP].[dR](T)[sP].[LR](G)[sP].[dR](T)[sP].[dR](C)[sP].[LR](A)[sP].[dR](G)[sP].[dR](A)[sP].[LR](A)[sP].[dR](T)[sP].[dR](C)[sP].[LR]([5meC])[sP].[LR](A) | 1214 |
| SEQ ID 212 | AAC AGT GTC AGA ATC CAT | ATGGATTCTGAC ACTGTT | SEQ ID 503 | [LR](A)[sP].[dR](A)[sP].[dR](C)[sP].[dR](A)[sP].[LR](G)[sP].[dR](T)[sP].[LR](G)[sP].[dR](T)[sP].[dR](C)[sP].[dR](A)[sP].[LR](G)[sP].[dR](A)[sP].[LR](A)[sP].[dR](T)[sP].[LR]([5meC])[sP].[dR](C)[sP].[LR](A)[sP].[LR](T) | 1215 |
| SEQ ID 213 | CAG TGT CAG AAT CCA TGG | CCATGGATTCTG ACACTG | SEQ ID 504 | [LR]([5meC])[sP].[dR](A)[sP].[dR](G)[sP].[dR](T)[sP].[LR](G)[sP].[dR](T)[sP].[dR](C)[sP].[LR](A)[sP].[dR](G)[sP].[dR](A)[sP].[LR](A)[sP].[dR](T)[sP].[dR](C)[sP].[dR](C)[sP].[LR](A)[sP].[dR](T)[sP].[LR]G)[sP].[LR](G) | 1216 |
| SEQ ID 214 | AGT GTC AGA ATC CAT GGG | CCCATGGATTCT GACACT | SEQ ID 505 | [LR](A)[sP].[dR](G)[sP].[dR](T)[sP].[LR](G)[sP].[dR](T)[sP].[dR](C)[sP].[LR](A)[sP].[dR](G)[sP].[dR](A)[sP].[LR](A)[sP].[dR](T)[sP].[dR](C)[sP].[dR](C)[sP].[LR](A)[sP].[dR](T)[sP].[dR](G)[sP].[LR](G)[sP].[LR](G) | 1217 |
| SEQ ID 215 | TGT CAG AAT CCA TGG GAA | TTCCCATGGATTC TGACA | SEQ ID 506 | [LR](T)[sP].[dR](G)[sP].[dR][T][sP].[dR](C)[sP].[LR](A)[sP].[dR](G)[sP].[dR](A)[sP].[LR](A)[sP].[dR](T)[sP].[dR](C)[sP].[dR](C)[sP].[LR](A)[sP].[dR](T)[sP].[LR](G)[sP].[dR](G)[sP].[dR](G)[sP].[LR](A)[sP].[LR](A) | 1218 |
| SEQ ID 216 | GTC AGA | CTTCCCATGGATT CTGAC | SEQ ID 507 | [LR](G)[sP].[dR](T)[sP].[dR](C)[sP].[LR](A)[sP].[dR](G)[sP].[dR](A)[sP].[LR](A)[sP].[dR](T)[sP].[dR](C)[sP].[dR](C)[sP].[LR](A)[sP].[dR] | 1219 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | ATC CAT GGG AAG | | | (T)[sP].[dR](G)[sP].[dR](G)[sP].[LR](G)[sP].[dR](A)[sP].[LR](A)[sP].[LR](G) | |
| SEQ ID 217 | CAG AAT CCA TGG GAA GAT | ATCTTCCCATGGA TTCTG | SEQ ID 508 | [LR]([5meC])[sP].[dR](A)[sP].[dR](G)[sP].[LR](A)[sP].[dR](A)[sP].[LR](T)[sP].[dR](C)[sP].[dR](C)[sP].[LR](A)[sP].[dR](T)[sP].[LR](G)[sP].[dR](G)[sP].[dR](G)[sP].[LR](A)[sP].[dR](A)[sP].[dR](G)[sP].[LR](A)[sP].[LR](T) | 1220 |
| SEQ ID 218 | AGA ATC CAT GGG AAG ATG | CATCTTCCCATGG ATTCT | SEQ ID 509 | [LR](A)[sP].[dR][G)[sP].[LR](A)[sP].[LR](A)[sP].[dR](T)[sP].[dR](C)[sP].[dR](C)[sP].[LR](A)[sP].[dR](T)[sP].[dR](G)[sP].[dR](G)[sP].[LR](G)[sP].[dR](A)[sP].[dR](A)[sP].[LR][G)[sP].[dR](A)[sP].[LR](T)[sP].[LR](G) | 1221 |
| SEQ ID 219 | AAT CCA TGG GAA GAT GTT | AACATCTTCCCAT GGATT | SEQ ID 510 | [LR](A)[sP].[dR](A)[sP].[dR](T)[sP].[dR](C)[sP].[LR]([5meC][sP].[dR](A)[sP].[dR](T)[sP].[LR][G)[sP].[dR](G)[sP].[LR](G)[sP].[dR](A)[sP].[dR](A)[sP].[LR](G)[sP].[dR](A)[sP].[dR](T)[sP].[dR](G)[sP].[LR](T)[sP].[LR](T) | 1222 |
| SEQ ID 220 | ATC CAT GGG AAG ATG TTC | GAACATCTTCCCA TGGAT | SEQ ID 511 | [LR](A)[sP].[dR](T)[sP].[dR][C)[sP].[dR](C)[sP].[LR](A)[sP].[dR](T)[sP].[dR](G)[sP].[dR](G)[sP].[LR](G)[sP].[dR](A)[sP].[dR](A)[sP].[LR](G)[sP].[dR](A)[sP].[dR](T)[sP].[LR][G][sP].[dR](T)[sP].[LR](T)[sP].[LR]([5meC]) | 1223 |
| SEQ ID 221 | CCA TGG GAA GAT GTT CTG | CAGAACATCTTCC CATGG | SEQ ID 512 | [LR]([5meC])[sP].[dR](C)[sP].[LR](A)[sP].[dR](T)[sP].[dR][G][sP].[dR](G)[sP].[LR](G)[sP].[dR](A)[sP].[dR](A)[sP].[dR](G)[sP].[LR](A)[sP].[dR](T)[sP].[LR](G)[sP].[dR](T)[sP].[dR](T)[sP].[dR](C)[sP].[LR](T)[P].[LR](G) | 1224 |
| SEQ ID 222 | CAT GGG AAG ATG TTCT GG | CCAGAACATCTTC CCATG | SEQ ID 513 | [LR]([5meC])[sP].[dR](A)[sP].[dR](T)[sP].[LR](G)[sP].[dR](G)[sP].[dR](G)[sP].[LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR](T)[sP].[LR](G)[sP].[LR](G) | 1225 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 223 | TGG GAA GAT GTT CTG GGG | CCCCAGAACATCT TCCCA | SEQ ID 514 | [LR](T)[sP].[dR](G)[sP].[dR](G)[sP].[dR](G)[sP].[LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR][T][sP].[LR](G)[sP].[dR](G)[sP].[LR](G)[sP].[LR](G) | 1226 |
| SEQ ID 224 | GGG AAG ATG TTCT GGG GA | TCCCCAGAACATC TTCCC | SEQ ID 515 | [LR](G)[sP].[dR][G)[sP].[dR](G)[sP].[dR](A)[sP].[LR](A)[sP].[dR](G)[sP].[dR](A)[sP].[dR](T)[sP].[LR](G)[sP].[dR](T)[sP].[dR](T)[sP].[dR](C)[sP].[LR](T)[sP].[dR](G)[sP].[dR](G)[sP].[dR](G)[sP].[LR](G)[sP].[LR](A) | 1227 |
| SEQ ID 225 | GAA GAT GTT CTG GGG AGG | CCTCCCCAGAAC ATCTTC | SEQ ID 516 | [LR](G)[sP].[dR](A)[sP].[dR](A)[sP].[dR](G)[sP].[LR](A)[sP].[dR](T)[sP].[dR][G)[sP].[dR](T)[sP].[LR](T)[sP].[dR](C)[sP].[dR](T)[sP].[dR](G)[sP].[LR](G)[sP].[dR](G)[sP].[dR](G)[sP].[dR](A)[sP].[LR](G)[sP].[LR](G) | 1228 |
| SEQ ID 226 | AAG ATG TTCT GGG GAG GT | ACCTCCCCAGAA CATCTT | SEQ ID 517 | [LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR](T)[sP].[LR](G)[sP].[dR](G)[sP].[dR](G)[sP].[LR](G)[sP].[dR](A)[sP].[dR](G)[sP].[LR](G)[sP].[LR](T) | 1229 |
| SEQ ID 227 | GAT GTT CTG GGG AGG TGA | TCACCTCCCCAGA ACATC | SEQ ID 518 | [LR](G)[sP].[dR](A)[sP].[dR](T)[sP].[dR](G)[sP].[LR](T)[sP].[dR](T)[sP].[dR](C)[sP].[dR](T)[sP].[LR](G)[sP].[dR](G)[sP].[dR](G)[sP].[dR](G)[sP].[LR](A)[sP].[dR](G)[sP].[dR](G)[sP].[dR](T)[sP].[LR](G)[sP].[LR](A) | 1230 |
| SEQ ID 228 | ATG TTCT GGG GAG GTG AC | GTCACCTCCCCAG AACAT | SEQ ID 519 | [LR](A)[sP].[dR](T)[sP].[dR](G)[sP].[dR](T)[sP].[LR](T)[sP].[dR](C)[sP].[dR](T)[sP].[LR](G)[sP].[dR](G)[sP].[dR](G)[sP].[LR](G)[sP].[dR](A)[sP].[dR](G)[sP].[LR](G)[sP].[dR](T)[sP].[dR](G)[sP].[LR](A)[sP].[LR]([5meC]) | 1231 |
| SEQ ID 229 | GTT CTG GGG AGG | TTGTCACCTCCCC AGAAC | SEQ ID 520 | [LR](G)[sP].[dR](T)[sP].[LR](T)[sP].[dR][C)[sP].[dR](T)[sP].[LR](G)[sP].[dR](G)[sP].[dR](G)[sP].[dR](G)[sP].[LR](A)[sP].[dR](G)[sP].[dR](G)[sP].[dR](T)[sP].[LR](G)[sP].[dR](A)[sP].[dR][C)[sP].[LR](A)[sP].[LR](A) | 1232 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TGA CAA | | | | |
| SEQ ID 230 | TTCT GGG GAG GTG ACA AC | GTTGTCACCTCCC CAGAA | SEQ ID 521 | [LR](T)[sP].[dR](T)[sP].[dR](C)[sP].[dR](T)[sP].[LR][G][sP].[dR](G)[sP].[dR](G)[sP].[dR](G)[sP].[LR](A)[sP].[dR](G)[sP].[dR](G)[sP].[dR](T)[sP].[LR](G)[sP].[dR](A)[sP].[dR][C)[sP].[dR][A][sP].[LR](A)[sP].[LR]([5meC]) | 1233 |
| SEQ ID 231 | CTG GGG AGG TGA CAA CTG | CAGTTGTCACCTC CCCAG | SEQ ID 522 | [LR]([5meC])[sP].[dR](T)[sP].[LR](G)[sP].[dR](G)[sP].[dR](G)[sP].[dR](G)[sP].[LR](A)[sP].[dR](G)[sP].[dR][G)[sP].[dR](T)[sP].[LR](G)[sP].[dR](A)[sP].[dR](C)[sP].[LR](A)[sP].[dR](A)[sP].[dR](C)[sP].[LR](T)[sP].[LR](G) | 1234 |
| SEQ ID 232 | TGG GGA GGT GAC AAC TGG | CCAGTTGTCACCT CCCCA | SEQ ID 523 | [LR](T)[sP].[dR](G)[sP].[dR](G)[sP].[dR](G)[sP].[LR](G)[sP].[dR](A)[sP].[dR](G)[sP].[LR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[LR](G) | 1235 |
| SEQ ID 233 | GGG AGG TGA CAA CTG GGC | GCCCAGTTGTCA CCTCCC | SEQ ID 524 | [LR](G)[sP].[dR](G)[sP].[dR](G)[sP].[LR](A)[sP].[dR](G)[sP].[dR](G)[sP].[dR](T)[sP].[LR][G)[sP].[dR](A)[sP].[dR][C)[sP].[LR](A)[sP].[dR](A)[sP].[dR](C)[sP].[dR](T)[sP].[LR](G)[sP].[dR](G)[sP].[LR](G)[sP].[LR]([5meC]) | 1236 |
| SEQ ID 234 | GGA GGT GAC AAC TGG GCC | GGCCCAGTTGTC ACCTCC | SEQ ID 525 | [LR](G)[sP].[dR](G)[sP].[dR](A)[sP].[dR](G)[sP].[LR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[LR][5meC])[sP].[LR]([5meC]) | 1237 |
| SEQ ID 235 | AGG TGA CAA CTG GGC CTG | CAGGCCCAGTTG TCACCT | SEQ ID 526 | [LR](A)[sP].[dR](G)[sP].[dR](G)[sP].[dR](T)[sP].[LR][G)[sP].[dR](A)[sP].[dR](C)[sP].[LR](A)[sP].[dR](A)[sP].[dR](C)[sP].[dR](T)[sP].[LR](G)[sP].[dR](G)[sP].[LR](G)[sP].[dR](C)[sP].[dR](C)[sP].[LR](T)[sP].[LR](G) | 1238 |
| SEQ ID 236 | GGT GAC AAC | GCAGGCCCAGTT GTCACC | SEQ ID 527 | [LR](G)[sP].[dR](G)[sP].[dR](T)[sP].[LR][G][sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[LR] | 1239 |

TABLE 12-continued

| Motif SEQ ID | Motif Sequence | Target site sequence | Target SEQ | Compounds (HELM ANNOTATION) | SEQ ID NO. |
|---|---|---|---|---|---|
| | Compound Table; compounds comprising modified nucleosides (SEQ ID NOs: 1011-1496). | | | | |
| | TGG GCC TGC | | | (G)[sP].[LR]([5meC]) | |
| SEQ ID 237 | TGA CAA CTG GGC CTG CAC | GTGCAGGCCCAG TTGTCA | SEQ ID 528 | [LR](T)[sP].[dR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR][G)[sP].[dR](C)[sP].[LR]([5meC])[sP].[dR](T)[sP].[dR](G)[sP].[dR][C)[sP].[LR](A)[sP].[LR]([5meC]) | 1240 |
| SEQ ID 238 | GAC AAC TGG GCC TGC ACC | GGTGCAGGCCCA GTTGTC | SEQ ID 529 | [LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[LR](G)[sP].[dR](C)[sP].[dR](A)[sP].[LR]([5meC])[sP].[LR]([5meC]) | 1241 |
| SEQ ID 239 | CAA CTG GGC CTG CAC CTG | CAGGTGCAGGCC CAGTTG | SEQ ID 530 | [LR]([5meC])[sP].[dR](A)[sP].[LR](A)[sP].[dR](C)[sP].[dR](T)[sP].[LR](G)[sP].[dR][G)[sP].[dR](G)[sP].[dR](C)[sP].[LR]([5meC])[sP].[dR](T)[sP].[dR](G)[sP].[dR](C)[sP].[LR](A)[sP].[dR](C)[sP].[dR](C)[sP].[LR](T)[sP].[LR](G) | 1242 |
| SEQ ID 240 | AAC TGG GCC TGC ACC TGC | GCAGGTGCAGGC CCAGTT | SEQ ID 531 | [LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR](G)[sP].[dR](C)[sP].[LR](A)[sP].[dR](C)[sP].[dR](C)[sP].[dR](T)[sP].[LR](G)[sP].[LR]([5meC]) | 1243 |
| SEQ ID 241 | CTG GGC CTG CAC CTG CTG | CAGCAGGTGCAG GCCCAG | SEQ ID 532 | [LR]([5meC])[sP].[dR](T)[sP].[dR](G)[sP].[dR](G)[sP].[LR][G)[sP].[dR][C)[sP].[dR](C)[sP].[dR][T][sP].[LR](G)[sP].[dR][C)[sP].[LR](A)[sP].[dR](C)[sP].[dR](C)[sP].[dR](T)[sP].[LR](G)[sP].[R](C)[sP].[LR](T)[sP].[LR](G) | 1244 |
| SEQ ID 242 | TGG GCC TGC ACC TGC TGC | GCAGCAGGTGCA GGCCCA | SEQ ID 533 | [LR](T)[sP].[dR](G)[sP].[dR][G)[sP].[LR][G)[sP].[dR](C)[sP].[dR](C)[sP].[dR](T)[sP].[LR](G)[sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[LR]([5meC]) | 1245 |
| SEQ ID 243 | GGC CTG | CTGCAGCAGGTG CAGGCC | SEQ ID 534 | [LR](G)[sP].[dR](G)[sP].[dR](C)[sP].[LR]([5meC])[sP].[dR](T)[sP].[dR](G)[sP].[dR][C)[sP].[LR](A)[sP].[dR](C)[sP].[dR](C)[sP].[dR](T)[sP]. | 1246 |

TABLE 12-continued

| Compound Table; compounds comprising modified nucleosides (SEQ ID NOs: 1011-1496). | | | | | |
|---|---|---|---|---|---|
| Motif SEQ ID | Motif Sequence | Target site sequence | Target SEQ | Compounds (HELM ANNOTATION) | SEQ ID NO. |
| | CAC CTG CTG CAG | | | [LR](G)[sP].[dR][C)[sP].[dR](T)[sP].[LR][G)[sP].[dR](C)[sP].[LR](A)[sP].[LR](G) | |
| SEQ ID 244 | GCC TGC ACC TGC TGC AGA | TCTGCAGCAGGT GCAGGC | SEQ ID 535 | [LR](G)[sP].[dR](C)[sP].[dR][C)[sP].[dR](T)[sP].[LR][G][sP].[dR](C)[sP].[LR](A)[sP].[dR](C)[sP].[dR](C)[sP].[dR](T)[sP].[LR](G)[sP].[dR](C)[sP].[dR](T)[sP].[LR][G)[sP].[dR](C)[sP].[dR](A)[sP].[LR](G)[sP].[LR](A) | 1247 |
| SEQ ID 245 | CTG CAC CTG CTG CAG AGG | CCTCTGCAGCAG GTGCAG | SEQ ID 536 | [LR]([5meC])[sP].[dR](T)[sP].[dR](G)[sP].[dR][C][sP].[LR](A)[sP].[dR](C)[sP].[dR](C)[sP].[dR](T)[sP].[LR](G)[sP].[dR][C)[sP].[dR](T)[sP].[dR](G)[sP].[LR]([5meC])[sP].[dR](A)[sP].[dR](G)[sP].[dR](A)[sP].[LR](G)[sP].[LR](G) | 1248 |
| SEQ ID 246 | TGC ACC TGC TGC AGA GGT | ACCTCTGCAGCA GGTGCA | SEQ ID 537 | [LR](T)[sP].[dR](G)[sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[dR](C)[sP].[LR](A)[sP].[dR][G][sP].[dR](A)[sP].[dR](G)[sP].[LR](G)[sP].([LR](T) | 1249 |
| SEQ ID 247 | CAC CTG CTG CAG AGG TGC | GCACCTCTGCAG CAGGTG | SEQ ID 538 | [LR]([5meC])[sP].[dR](A)[sP].[dR](C)[sP].[dR](C)[sP].[LR](T)[sP].[dR](G)[sP].[dR][C)[sP].[dR](T)[sP].[LR](G)[sP].[dR][C)[sP].[dR](A)[sP].[dR](G)[sP].[LR](A)[sP].[dR](G)[sP].[dR](G)[sP].[dR](T)[sP].[LR](G)[sP].[LR]([5meC]) | 1250 |
| SEQ ID 248 | ACC TGC TGC AGA GGT GCA | TGCACCTCTGCA GCAGGT | SEQ ID 539 | [LR](A)[sP].[dR](C)[sP].[dR](C)[sP].[dR](T)[sP].[LR](G)[sP].[dR](C)[sP].[dR](T)[sP].[LR](G)[sP].[dR](C)[sP].[LR](A)[sP].[dR](G)[sP].[dR](A)[sP][dR](G)[sP].[LR](G)[sP].[dR](T)[sP].[dR](G)[sP].[LR]([5meC])[sP].[LR](A) | 1251 |
| SEQ ID 249 | CTG CTG CAG AGG TGC ACG | CGTGCACCTCTG CAGCAG | SEQ ID 540 | [LR]([5meC])[sP].[dR](T)[sP].[LR](G)[sP].[dR](C)[sP].[dR](T)[sP].[LR](G)[sP].[dR](C)[sP].[dR](A)[sP].[dR][G)[sP].[LR](A)[sP].[dR](G)[sP].[dR](G)[sP].[dR](T)[sP].[LR](G)[sP].[dR](C)[sP].[dR](A)[sP].[LR]([5meC])[sP].[LR](G) | 1252 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 250 | TGC TGC AGA GGT GCA CGT | ACGTGCACCTCT GCAGCA | SEQ ID 541 | [LR](T)[sP].[dR](G)[sP].[dR](C)[sP].[dR](T)[sP].[LR](G)[sP].[dR](C)[sP].[dR](A)[sP].[dR](G)[sP].[LR](A)[sP].[dR](G)[sP].[dR][G][sP].[dR](T)[sP].[LR](G)[sP].[dR](C)[sP].[dR](A)[sP].[dR](C)[sP].[LR](G)[sP].[LR](T) | 1253 |
| SEQ ID 251 | CTG CAG AGG TGC ACG TAG | CTACGTGCACCTC TGCAG | SEQ ID 542 | [LR]([5meC])[sP].[dR](T)[sP].[dR](G)[sP].[dR](C)[sP].[LR](A)[sP].[dR](G)[sP].[dR](A)[sP].[dR](G)[sP].[LR](G)[sP].[dR](T)[sP].[dR](G)[sP].[dR](C)[sP].[LR](A)[sP].[dR]([5meC])[sP].[dR](G)[sP].[dR](T)[sP].[LR](A)[sP].[LR](G) | 1254 |
| SEQ ID 252 | TGC AGA GGT GCA CGT AGT | ACTACGTGCACCT CTGCA | SEQ ID 543 | [LR](T)[sP].[dR](G)[sP].[dR](C)[sP].[LR](A)[sP].[dR](G)[sP].[dR](A)[sP].[dR](G)[sP].[LR](G)[sP].[dR](T)[sP].[dR](G)[sP].[dR](C)[sP].[LR](A)[sP].[dR](C)[sP].[LR](G)[sP].[dR](T)[sP].[dR](A)[sP].[LR](G)[sP].[LR](T) | 1255 |
| SEQ ID 253 | CAG AGG TGC ACG TAG TCT | AGACTACGTGCA CCTCTG | SEQ ID 544 | [LR]([5meC])[sP].[dR](A)[sP].[dR](G)[sP].[LR](A)[sP].[dR](G)[sP].[dR](G)[sP].[dR](T)[sP].[LR](G)[sP].[dR](C)[sP].[LR](A)[sP].[dR]([5meC])[sP].[dR](G)[sP].[dR](T)[sP].[LR](A)[sP].[dR](G)[sP].[dR](T)[sP].[LR]([5meC])[sP].[LR](T) | 1256 |
| SEQ ID 254 | AGA GGT GCA CGT AGT CTG | CAGACTACGTGC ACCTCT | SEQ ID 545 | [LR](A)[sP].[dR](G)[sP].[dR](A)[sP].[dR](G)[sP].[LR](G)[sP].[dR](T)[sP].[dR](G)[sP].[dR](C)[sP].[LR](A)[sP].[dR]([5meC])[sP].[dR](G)[sP].[dR](T)[sP].[LR](A)[sP].[dR](G)[sP].[dR](T)[sP].[dR](C)[sP].[LR](T)[sP].[LR](G) | 1257 |
| SEQ ID 255 | AGG TGC ACG TAG TCT GAG | CTCAGACTACGT GCACCT | SEQ ID 546 | [LR](A)[sP].[dR](G)[sP].[dR](G)[sP].[dR](T)[sP].[LR](G)[sP].[dR](C)[sP].[dR](A)[sP].[dR](C)[sP].[LR](G)[sP].[dR](T)[sP].[dR](A)[sP].[dR](G)[sP].[LR](T)[sP].[dR](C)[sP].[dR](T)[sP].[dR](G)[sP].[LR](A)[sP].[LR](G) | 1258 |
| SEQ ID 256 | GGT GCA CGT AGT | ACTCAGACTACG TGCACC | SEQ ID 547 | [LR](G)[sP].[dR](G)[sP].[dR](T)[sP].[LR](G)[sP].[dR](C)[sP].[dR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR](G)[sP].[dR](A)[sP].[LR](G)[sP].[LR](T) | 1259 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CTG AGT | | | | |
| SEQ ID 257 | TGC ACG TAG TCT GAG TGC | GCACTCAGACTA CGTGCA | SEQ ID 548 | [LR](T)[sP].[dR](G)[sP].[dR](C)[sP].[LR](A)[sP].[dR][C)[sP].[LR](G)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[LR]([5meC]) | 1260 |
| SEQ ID 258 | GCA CGT AGT CTG AGT GCT | AGCACTCAGACT ACGTGC | SEQ ID 549 | [LR](G)[sP].[dR](C)[sP].[dR](A)[sP].[dR](C)[sP].[LR](G)[sP].[dR](T)[sP].[dR](A)[sP].[dR](G)[sP].[LR](T)[sP].[dR](C)[sP].[dR](T)[sP].[dR](G)[sP].[LR](A)[sP].[dR][G)[sP].[dR](T)[sP].[dR](G)[sP].[LR]([5meC])[sP].[LR](T) | 1261 |
| SEQ ID 259 | ACG TAG TCT GAG TGC TGC | GCAGCACTCAGA CTACGT | SEQ ID 550 | [LR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR][G)[sP].[dR](A)[sP].[dR](G)[sP].[dR](T)[sP].[LR](G)[sP].[dR](C)[sP].[dR](T)[sP].[LR](G)[sP].[LR]([5meC]) | 1262 |
| SEQ ID 260 | CGT AGT CTG AGT GCT GCG | CGCAGCACTCAG ACTACG | SEQ ID 551 | [LR]([5meC])[sP].[dR](G)[sP].[dR](T)[sP].[dR](A)[sP].[LR](G)[sP].[dR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[dR](G)[sP].[LR]([5meC])[sP].[LR](G) | 1263 |
| SEQ ID 261 | TAG TCT GAG TGC TGC GGA | TCCGCAGCACTC AGACTA | SEQ ID 552 | [LR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR][T)[sP].[LR](G)[sP].[dR](C)[sP].[dR](T)[sP].[LR](G)[sP].[dR]([5meC])[sP].[dR](G)[sP].[LR](G)[sP].[LR](A) | 1264 |
| SEQ ID 262 | AGT CTG AGT GCT GCG GAC | GTCCGCAGCACT CAGACT | SEQ ID 553 | [LR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[LR]([5meC]) | 12.65 |
| SEQ ID 263 | TCT GAG TGC | GAGTCCGCAGCA CTCAGA | SEQ ID 554 | [LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[LR] | 1266 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| | TGC GGA CTC | | | (T)[sP].[LR]([5meC]) | |
| SEQ ID 264 | CTG AGT GCT GCG GAC TCA | TGAGTCCGCAGC ACTCAG | SEQ ID 555 | [LR]([5meC])[sP].[dR](T)[sP].[LR](G)[sP].[dR](A)[sP].[dR](G)[sP].[dR](T)[sP][LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[LR]([5meC])[sP].[LR](A) | 1267 |
| SEQ ID 265 | GAG TGC TGC GGA CTC AGC | GCTGAGTCCGCA GCACTC | SEQ ID 556 | [LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[LR](T)[sP].[dR](C)[sP].[dR](A)[sP].[LR](G)[sP].[LR]([5meC]) | 1268 |
| SEQ ID 266 | AGT GCT GCG GAC TCA GCA | TGCTGAGTCCGC AGCACT | SEQ ID 557 | [LR](A)[sP].[dR](G)[sP].[dR](T)[sP].[LR](G)[sP].[dR][C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[dR](G)[sP].[LR]([5meC])[sP].[LR](A) | 1269 |
| SEQ ID 267 | TGC TGC GGA CTC AGC AGA | TCTGCTGAGTCC GCAGCA | SEQ ID 558 | [LR](T)[sP].[dR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[dR](G)[sP].[dR](C)[sP].[dR](A)[sP].[LR](G)[sP].[LR](A) | 1270 |
| SEQ ID 268 | GCT GCG GAC TCA GCA GAC | GTCTGCTGAGTC CGCAGC | SEQ ID 559 | [LR](G)[sP].[dR](C)[sP].[dR](T)[sP].[LR](G)[sP].[dR]([5meC])[sP].[dR](G)[sP].[dR][G)[sP].[LR](A)[sP].[dR](C)[sP].[dR](T)[sP].[dR](C)[sP].[LR](A)[sP].[dR](G)[sP].[dR](C)[sP].[LR](A)[sP].[dR](G)[sP].[LR](A)[sP].[LR]([5meC]) | 1271 |
| SEQ ID 269 | TGC GGA CTC AGC AGA CCC | GGGTCTGCTGAG TCCGCA | SEQ ID 560 | [LR](T)[sP].[dR](G)[sP].[dR]([5meC])[sP].[dR](G)[sP].[LR](G)[sP].[dR](A)[sP].[dR](C)[sP].[dR](T)[sP].[LR]([5meC])[sP].[dR](A)[sP].[dR](G)[sP].[dR][C)[sP].[LR](A)[sP].[dR](G)[sP].[dR](A)[sP].[dR](C)[sP].[LR]([5meC])[sP].[LR]([5meC]) | 1272 |
| SEQ ID 270 | GCG GAC | CGGGTCTGCTGA GTCCGC | SEQ ID 561 | [LR](G)[sP].[dR]([5meC])[sP].[dR](G)[sP].[dR][G)[sP].[LR](A)[sP].[dR](C)[sP].[dR](T)[sP].[dR](C)[sP].[LR](A)[sP].[dR](G)[sP].[dR](C) | 1273 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TCA GCA GAC CCG | | | [sP].[dR](A)[sP].[LR](G)[sP].[dR](A)[sP].[dR](C)[sP].[dR](C)[sP].[LR]([5meC])[sP].[LR](G) | |
| SEQ ID 271 | GGA CTC AGC AGA CCC GGC | GCCGGGTCTGCT GAGTCC | SEQ ID 562 | [LR](G)[sP][dR](G)[sP].[dR](A)[sP].[dR](C)[sP].[LR](T)[sP].[dR](C)[sP].[dR](A)[sP].[dR](G)[sP].[LR]([5meC])[sP].[dR](A)[sP].[dR](G)[sP].[dR](A)[sP].[LR]([5meC])[sP].[dR](C)[sP].[dR]([5meC])[sP].[dR](G)[sP].[LR](G)[sP].[LR]([5meC]) | 1274 |
| SEQ ID 272 | GAC TCA GCA GAC CCG GCC | GGCCGGGTCTGC TGAGTC | SEQ ID 563 | [LR](G)[sP].[dR](A)[sP].[dR](C)[sP].[dR](T)[sP].[LR]([5meC])[sP].[dR](A)[sP].[dR](G)[sP].[dR](C)[sP].[LR](A)[sP].[dR](G)[sP].[dR](A)[sP].[dR](C)[sP].[LR]([5meC])[sP].[dR]([5meC])[sP].[dR](G)[sP].[dR](G)[sP].[LR]([5meC])[sP].[LR]([5meC]) | 1275 |
| SEQ ID 273 | CTC AGC AGA CCC GGC CAC | GTGGCCGGGTCT GCTGAG | SEQ ID 564 | [LR]([5meC])[sP].[dR](T)[sP].[dR](C)[sP].[dR](A)[sP].[LR](G)[sP].[dR](C)[sP].[dR](A)[sP].[dR](G)[sP].[LR](A)[sP].[dR](C)[sP].[dR](C)[sP].[dR](C)[sP].[LR](G)[sP].[dR](G)[sP].[dR](C)[sP].[dR](C)[sP].[LR](A)[sP].[LR]([5meC]) | 1276 |
| SEQ ID 274 | TCA GCA GAC CCG GCC ACC | GGTGGCCGGGTC TGCTGA | SEQ ID 565 | [LR](T)[sP].[dR](C)[sP].[LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[LR]([5meC])[sP].[LR]([5meC]) | 1277 |
| SEQ ID 275 | AGC AGA CCC GGC CAC CGG | CCGGTGGCCGGG TCTGCT | SEQ ID 566 | [LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[dR](C)[sP].[dR](C)[sP].[LR](G)[sP].[LR](G) | 1278 |
| SEQ ID 276 | GCA GAC CCG GCC ACC GGC | GCCGGTGGCCGG GTCTGC | SEQ ID 567 | [LR](G)[sP].[dR](C)[sP].[dR](A)[sP].[dR](G)[sP].[LR](A)[sP].[dR](C)[sP].[dR](C)[sP].[dR](C)[sP].[LR][G)[sP].[dR](G)[sP].[dR](C)[sP].[dR](C)[sP].[LR](A)[sP].[dR](C)[sP].[dR]([5meC])[sP].[dR](G)[sP].[LR](G)[sP].[LR]([5meC]) | 12.79 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| SEQ ID 277 | AGA CCC GGC CAC CGG CCT | AGGCCGGTGGCC GGGTCT | SEQ ID 568 | [LR](A)[sP].[dR](G)[sP].[LR](A)[sP].[dR][C)[sP].[dR](C)[sP].[dR](C)[sP].[LR](G)[sP].[dR](G)[sP].[dR](C)[sP].[dR](C)[sP].[LR](A)[sP].[dR](C)[sP].[LR]([5meC])[sP].[dR](G)[sP].[dR](G)[sP].[dR](C)[sP].[LR]([5meC])[sP].[LR](T) | 1280 |
| SEQ ID 278 | GAC CCG GCC ACC GGC CTT | AAGGCCGGTGGC CGGGTC | SEQ ID 569 | [LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[dR](C)[sP].[dR](C)[sP].[LR][G)[sP].[dR](G)[sP].[dR](C)[sP].[dR](C)[sP].[LR](T)[sP].[LR](T) | 1281 |
| SEQ ID 279 | CCC GGC CAC CGG CCT TAC | GTAAGGCCGGTG GCCGGG | SEQ ID 570 | [LR]([5meC])[sP].[dR](C)[sP].[dR](C)[sP].[LR](G)[sP].[dR](G)[sP].[dR](C)[sP].[dR](C)[sP].[LR](A)[sP].[dR](C)[sP].[dR](C)[sP].[LR](G)[sP].[dR](G)[sP].[dR](C)[sP].[dR][C)[sP].[LR](T)[sP].[dR](T)[sP].[LR](A)[sP].[LR]([5meC]) | 1282 |
| SEQ ID 280 | CCG GCC ACC GGC CTT ACT | AGTAAGGCCGGT GGCCGG | SEQ ID 571 | [LR]([5meC])[sP].[dR](C)[sP].[LR](G)[sP].[dR](G)[sP].[dR](C)[sP].[dR](C)[sP].[LR](A)[sP].[dR](C)[sP].[dR](C)[sP].[LR](G)[sP].[dR](G)\|sP].[dR](C)[sP].[dR](C)[sP].[LR](T)[sP].[dR](T)[sP].[dR](A)[sP].[LR]([5meC][sP].[LR](T) | 1283 |
| SEQ ID 281 | GGC CAC CGG CCT TAC TCC | GGAGTAAGGCCG GTGGCC | SEQ ID 572 | [LR](G)[sP].[dR](G)[sP].[dR](C)[sP].[dR](C)[sP].[LR](A)[sP].[dR](C)[sP].[dR][C)[sP].[LR](G)[sP].[dR][G)[sP].[dR](C)[sP].[dR](C)[sP].[LR](T)[sP].[dR](T)[sP].[LR](A)[sP].[dR](C)[sP].[dR](T)[sP].[LR]([5meC])[sP].[LR]([5meC]) | 1284 |
| SEQ ID 282 | GCC ACC GGC CTT ACT CCA | TGGAGTAAGGCC GGTGGC | SEQ ID 573 | [LR](G)[sP].[dR](C)[sP].[dR](C)[sP].[LR][A)[sP].[dR](C)[sP].[dR](C)[sP].[LR](G)[sP].[dR](G)[sP].[dR](C)[sP].[dR](C)[sP].[LR](T)[sP].[dR](T)[sP].[LR](A)[sP].[dR](C)[sP].[dR](T)[sP].[dR](C)[sP].[LR]([5meC])[sP].[LR](A) | 1285 |
| SEQ ID 283 | CAC CGG CCT TAC | AATGGAGTAAGG CCGGTG | SEQ ID 574 | [LR]([5meC])[sP].[dR](A)[sP].[dR](C)[sP].[dR](C)[sP].[LR](G)[sP].[dR](G)[sP].[dR](C)[sP].[dR](C)[sP].[LR](T)[sP].[dR](T)[sP].[dR](A)[sP].[dR](C)[sP].[LR](T)[sP].[dR](C)[sP].[dR](C)[sP].[dR](A)[sP].[LR](T)[sP].[LR](T) | 1286 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TCC ATT | | | | |
| SEQ ID 284 | ACC GGC CTT ACT CCA TTT | AAATGGAGTAAG GCCGGT | SEQ ID 575 | [LR](A)[sP].[dR][C)[sP].[dR](C)[sP].[LR](G)[sP].[dR][G)[sP].[dR](C)[sP].[dR](C)[sP].[LR](T)[sP].[dR](T)[sP].[dR](A)[sP].[dR](C)[sP].[LR](T)[sP].[dR](C)[sP].[dR](C)[sP].[LR](A)[sP].[dR](T)[sP].[LR](T)[sP].[LR](T) | 1287 |
| SEQ ID 285 | CGG CCT TAC TCC ATT TCC | GGAAATGGAGTA AGGCCG | SEQ ID 576 | [LR]([5meC])[sP].[dR](G)[sP].[dR](G)[sP].[dR](C)[sP].[LR]([5meC])[sP].[dR](T)[sP].[dR](T)[sP].[LR](A)[sP].[dR][C)[sP].[LR](T)[sP].[dR](C)[sP].[dR](C)[sP].[LR](A)[sP].[dR](T)[sP].[dR](T)[sP].[dR](T)[sP].[LR]([5meC])[sP].[LR]([5meC]) | 1288 |
| SEQ ID 286 | GGC CTT ACT CCA TTTC CC | GGGAAATGGAGT AAGGCC | SEQ ID 577 | [LR](G)[sP].[dR](G)[sP].[dR](C)[sP].[dR](C)[sP].[LR](T)[sP].[dR](T)[sP].[dR](A)[sP].[dR](C)[sP].[LR](T)[sP].[dR](C)[sP].[dR](C)[sP].[LR](A)[sP].[dR](T)[sP].[LR](T)[sP].[dR](T)[sP].[dR][C][sP].[LR]([5meC])[sP].[LR]([5meC]) | 1289 |
| SEQ ID 287 | CCT TAC TCC ATT TCC CTG | CAGGGAAATGGA GTAAGG | SEQ ID 578 | [LR]([5meC])[sP].[dR](C)[sP].[dR](T)[sP].[dR](T)[sP].[LR](A)[sP].[dR](C)[sP].[dR](T)[sP].[dR](C)[sP].[LR]([5meC])[sP].[dR](A)[sP].[dR](T)[sP].[dR](T)[sP].[LR](T)[sP].[dR](C)[sP].[dR](C)[sP].[dR](C)[sP].[LR](T)[sP].[LR](G) | 1290 |
| SEQ ID 288 | CTT ACT CCA TTTC CCT GG | CCAGGGAAATGG AGTAAG | SEQ ID 579 | [LR]([5meC])[sP].[dR](T)[sP].[dR](T)[sP].[LR](A)[sP].[dR][C)[sP].[LR](T)[sP].[dR](C)[sP].[dR](C)[sP].[LR](A)[sP].[dR](T)[sP].[dR](T)[sP].[dR](T)[sP].[LR]([5meC])[sP].[dR](C)[sP].[dR](C)[CP].[dR](T)[sP).[LR](G)[sP].[LR](G) | 1291 |
| SEQ ID 289 | TAC TCC ATT TCC CTG GAA | TTCCAGGGAAAT GGAGTA | SEQ ID 580 | [LR](T)[sP].[dR](A)[sP].[dR](C)[sP].[LR](T)[sP].[dR](C)[sP].[dR](C)[sP].[LR](A)[sP].[dR](T)[sP].[LR](T)[sP].[dR](T)[sP].[dR][C)[sP].[dR](C)[sP].[LR]([5meC])[sP].[dR](T)[sP].[dR](G)[sP].[dR](G)[sP].[LR](A)[sP].[LR](A) | 1292 |
| SEQ ID 290 | ACT CCA TTTC | CTTCCAGGGAAA TGGAGT | SEQ ID 581 | [LR](A)[sP].[dR](C)[sP].[dR](T)[sP].[dR](C)[sP].[LR]([5meC])[sP].[dR](A)[sP].[dR](T)[sP].[dR](T)[sP].[LR](T)[sP].[dR](C)[sP].[dR](C)[sP].[dR](C)[sP].[LR](T)[sP].[dR](G)[sP].[dR](G)[sP].[dR](A)[sP].[LR] | 1293 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CCT GGA AG | | | (A)[sP].[LR](G) | |
| SEQ ID 291 | TCCATT TCCCTG GAAGGA | TCCTTCCAGGGA AATGGA | SEQ ID 582 | [LR](T)[sP].[dR](C)[sP].[dR](C)[sP].[LR](A)[sP].[dR](T)[sP].[LR](T)[sP].[dR](T)[sP].[dR](C)[sP].[dR](C)[sP].[LR]([5meC])[sP].[dR](T)[sP][dR](G)[sP].[dR](G)[sP].[LR](A)[sP].[dR](A)[sP].[dR](G)[sP].[LR](G)[sP].[LR](A) | 1294 |
| SEQ ID 292 | CCATTT CCCTGG AAGGAA | TTCCTTCCAGGG AAATGG | SEQ ID 583 | [LR]([5meC])[sP].[dR](C)[sP].[dR](A)[sP].[dR](T)[sP].[LR](T)[sP].[dR](T)[sP].[dR](C)[sP].[dR](C)[sP].[LR]([5meC])[sP].[dR](T)[sP].[dR](G)[sP].[dR][G][sP].[LR](A)[sP].[dR](A)[sP].[dR](G)[sP].[dR](G)[sP].[LR](A)[sP].[LR](A) | 1295 |
| SEQ ID 293 | ATT TCC CTG GAA GGA AAG | CTTTCCTTCCAGG GAAAT | SEQ ID 584 | [LR](A)[sP].[dR](T)[sP].[LR](T)[sP].[dR](T)[sP].[dR][C)[sP].[dR](C)[sP].[LR]([5meC])[sP].[dR](T)[sP].[dR](G)[sP].[dR](G)[sP].[LR](A)[sP].[dR](A)[sP].[dR](G)[sP].[dR](G)[sP].[LR](A)[sP].[dR](A)[sP].[LR](A)[sP].[LR](G) | 1296 |
| SEQ ID 294 | TTTC CCT GGA AGG AAA GA | TCTTTCCTTCCAG GGAAA | SEQ ID 585 | [LR](T)[sP].[dR](T)[sP].[dR](T)[sP].[dR](C)[sP].[LR]([5meC])[sP].[dR](C)[sP].[dR](T)[sP].[dR](G)[sP].[LR](G)[sP].[dR](A)[sP].[dR](A)[sP].[dR](G)[sP].[LR](G)[sP].[dR](A)[sP].[dR](A)[sP].[dR](A)[sP].[LR](G)[sP].[LR](A) | 1297 |
| SEQ ID 295 | TCC CTG GAA GGA AAG ACC | GGTCTTTCCTTCC AGGGA | SEQ ID 586 | [LR](T)[sP].[dR](C)[sP].[dR](C)[sP].[dR](C)[&P].[LR](T)[sP].[dR](G)[sP].[dR](G)[sP].[dR](A)[sP].[LR](A)[sP].[dR](G)[sP].[dR](G)[sP].[dR](A)[sP].[LR](A)[sP].[dR](A)[sP].[dR](G)[sP].[dR](A)[sP].[LR]([5meC)[sP].[LR]([5meC]) | 1298 |
| SEQ ID 296 | CCC TGG AAG GAA AGA CCA | TGGTCTTTCCTTC CAGGG | SEQ ID 587 | [LR]([5meC])[sP].[dR](C)[sP].[dR](C)[sP].[dR](T)[sP].[LR](G)[sP].[dR](G)[sP].[LR](A)[sP].[dR](A)[sP].[dR](G)[sP].[dR](G)[sP].[LR](A)[sP].[dR](A)[sP].[dR](A)[sP].[dR](G)[sP].[LR](A)[sP].[dR](C)[sP].[LR]([5meC])[sP].[LR](A) | 1299 |
| SEQ ID 297 | CTG GAA GGA AAG ACC AAA | TTTGGTCTTTCCT TCCAG | SEQ ID 588 | [LR]([5meC])[sP].[dR](T)[sP].[dR](G)[sP].[dR](G)[sP].[LR](A)[sP].[LR](A)[sP].[dR](G)[sP].[LR](G)[sP].[dR](A)[sP].[dR](A)[sP].[LR](A)[sP].[LR](G)[sP].[dR](A)[sP].[dR](C)[sP].[LR]([5meC])[sP].[dR](A)[sP].[LR](A)[sP].[LR](A) | 1300 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 298 | TGG AAG GAA AGA CCA AAG | CTTTGGTCTTTCC TTCCA | SEQ ID 589 | [LR](T)[sP][LR](G)[sP].[dR](G)[sP].[LR](A)[sP].[dR](A)[sP].[dR](G)[sP].[LR](G)[sP].[dR](A)[sP].[dR](A)[sP].[LR](A)[sP].[dR](G)[sP].[dR](A)[sP].[LR]([5meC])[sP].[dR](C)[sP].[LR](A)[sP].[dR](A)[sP].[LR](A)[sP].[LR](G) | 1301 |
| MOUSE | | | | | |
| SEQ ID 597 | TCCATG GGAAGA TGTTCT | AGAACATCTTCCCA TGGA | SEQ ID 699 | [LR](T)[sP].[dR](C)[sP].[dR](C)[sP].[LR](A)[sP].[dR](T)[sP].[dR](G)[sP].[dR](G)[sP].[LR](G)[sP].[dR][A)[sP].[dR](A)[sP].[dR](G)[sP].[LR](A)[sP].[dR](T)[sP].[LR](G)[sP].[dR](T)[sP].[dR](T)[sP].[LR]([5meC])[sP].[LR](T) | 1302 |
| SEQ ID 598 | GGAAGA TGTTCT GGGGAG | CTCCCCAGAACATC TTCC | SEQ ID 700 | [LR](G)[sP].[dR](G)[sP].[dR](A)[sP].[dR](A)[sP].[LR](G)[sP].[dR](A)[sP].[dR](T)[sP].[dR][G)[sP].[LR](T)[sP].[dR](T)[sP].[dR](C)[sP].[dR](T)[sP].[LR](G)[sP].[dR](G)[sP].[dR](G)[sP].[dR](G)[sP].[LR](A)[sP].[LR](G) | 1303 |
| SEQ ID 599 | TGTTCT GGGGAG | TGTCACCTCCCCAG AACA | SEQ ID 701 | [LR](T)[sP].[dR](G)[sP].[dR](T)[sP].[LR](T)[sP].[dR](C)[sP].[dR](T)[sP].[LR](G)[sP].[dR](G)[sP].[dR][G][sP].[dR](G)[sP].[LR](A)[sP].[dR](G)[sP].[dR](G)[sP].[dR](T)[sP].[LR](G)[sP].[dR][A][sP].[LR]([5meC])[sP].[LR](A) | 1304 |
| SEQ ID 600 | GGGGAG GTGACA ACTGGG | CCCAGTTGTCACCT CCCC | SEQ ID 702 | [LR](G)[sP].[dR](G)[sP].[dR](G)[sP].[dR](G)[sP].[LR](A)[sP].[dR](G)[sP].[dR][G)[sP].[dR](T)[sP].[LR][G)[sP].[dR](A)[sP].[dR](C)[sP].[dR](A)[sP].[LR](A)[sP].[dR](C)[sP].[dR](T)[sP].[dR](G)[sP].[LR](G)[sP].[LR](G) | 1305 |
| SEQ ID 601 | GTGACA ACTGGG CCTGCA | TGCAGGCCCAGTT GTCAC | SEQ ID 703 | [LR](G)[sP].[dR](T)[sP].[LR][G][sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR](G)[sP].[LR]([5meC])[sP].[LR](A) | 1306 |
| SEQ ID 602 | ACTGGG CCTGCA CCTGCT | AGCAGGTGCAGGC | SEQ ID 704 | [LR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR][G][sP].[dR](C)[sP].[LR](A)[sP].[dR](C)[sP].[LR]([5meC])[sP].[dR](T)[sP].[dR](G)[sP].[LR]([5meC])[sP].[LR](T) | 1307 |
| SEQ ID 603 | CCTGCA CCTGCT GCAGAG | CTCTGCAGCAGGT GCAGG | SEQ ID 705 | [LR]([5meC])[sP].[dR](C)[sP].[dR](T)[sP].[LR][G][sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[dR](C)[sP].[dR](A)[sP].[dR](G)[sP].[LR](A)[sP].[LR](G) | 1308 |
| SEQ ID 604 | CCTGCT GCAGAG | GTGCACCTCTGCA GCAGG | SEQ ID 706 | [LR]([5meC])[sP].[dR](C)[sP].[dR](T)[sP].[LR](G)[sP].[dR](C)[sP].[dR](T)[sP].[LR](G)[sP].[dR](C)[sP].[dR](A)[sP].[dR](G)[sP].[LR](A) | 1309 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | GTGCAC | | | [sP].[dR](G)[sP].[dR](G)[sP].[dR](T)[sP].[LR](G)[sP].[dR](C)[sP].[LR](A)[sP].[LR]([5meC]) | |
| SEQ ID 605 | TGAGTG CTGCGG ACTCAG | CTGAGTCCGCAGCA CTCA | SEQ ID 707 | [LR](T)[sP].[dR][G)[sP].[dR](A)[sP].[dR](G)[sP].[LR](T)[sP].[dR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[LR](G) | 1310 |
| SEQ ID 606 | CTGCGG ACTCAG CAGACC | GGTCTGCTGAGTC CGCAG | SEQ ID 708 | [LR]([5meC])[sP].[dR](T)[sP].[LR](G)[sP].[dR]([5meC])[sP].[dR](G)[sP].[dR][G)[sP].[LR](A)[sP].[dR](C)[sP].[dR](T)[sP].[dR](C)[sP].[LR](A)[sP].[dR](G)[sP].[dR](C)[sP].[LR](A)[sP].[dR](G)[sP].[dR](A)[sP].[LR]([5meC])[sP].[LR]([5meC]) | 1311 |
| SEQ ID 607 | ACTCAG CAGACC CGGCCA | TGGCCGGGTCTGC TGAGT | SEQ ID 709 | [LR](A)[sP].[dR](C)[sP].[dR](T)[sP].[dR](C)[sP].[LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[LR](A) | 1312 |
| SEQ ID 608 | CATGGG AGGATG TTCTGG | CCAGAACATCTTC CCATG | SEQ ID 710 | [LR]([5meC])[sP].[dR](A)[sP].[dR](T)[sP].[LR](G)[sP].[dR](G)[sP].dR](G)[sP].[LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR](T)[sP].[LR](G)[sP].[LR](G) | 1313 |
| SEQ ID 609 | TGGGAA GATGTT CTGGGG | CCCCAGAACATCTT CCCA | SEQ ID 711 | [LR](T)[sP].[dR](G)[sP].[dR](G)[sP].[dR](G)[sP].[LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR](T)[sP].[LR](G)[sP].[dR][G][sP].[LR](G)[sP].[LR](G) | 1314 |
| SEQ ID 610 | AAGATG TTCTGG GGAGGT | ACCTCCCCAGAACA TCTT | SEQ ID 712 | [LR](A)[sP].[dR](A)[sP].[dR](G)[sP].[LR](A)[sP].[dR](T)[sP].[dR](G)[sP].[dR](T)[sP].[LR](T)[sP].[dR](C)[sP].[dR](T)[sP].[LR](G)[sP].[dR](G)[sP].[dR](G)[sP].[LR](G)[sP].[dR](A)[sP].[dR](G)[sP].[LR](G)[sP].[LR](T) | 1315 |
| SEQ ID 611 | GATGTT CTGGGG AGGTGA | TCACCTCCCCAGAA CATC | SEQ ID 713 | [LR](G)[sP].[dR](A)[sP].[dR](T)[sP].[dR](G)[sP].[LR](T)[sP].[dR](T)[sP].[dR](C)[sP].[dR](T)[sP].[LR](G)[sP].[dR](G)[sP].[dR](G)[sP].[dR](G)[sP].[LR](A)[sP].[dR](G)[sP].[dR](G)[sP].[dR](T)[sP].[LR](G)[sP].[LR](A) | 1316 |
| SEQ ID 612 | TTCTGG GGAGGT GACAAC | GTTGTCACCTCCCC AGAA | SEQ ID 714 | [LR](T)[sP].[dR](T)[sP].[dR](C)[sP].[dR](T)[sP].[LR](G)[sP].[dR](G)[sP].[dR](G)[sP].[dR](G)[sP].[LR](A)[sP].[dR](G)[sP].[dR][G)[sP].[dR](T)[sP].[LR](G)[sP].[dR](A)[sP].[dR](C)[sP].[dR](A)[sP].[LR](A)[sP].[LR]([5meC]) | 1317 |
| SEQ ID 613 | CTGGGG AGGTGA CAACTG | CAGTTGTCACCTCC CCAG | SEQ ID 715 | [LR]([5meC])[sP].[dR](T)[sP].[LR](G)[sP].[dR](G)[sP].[dR](G)[sP].[dR](G)[sP].[LR](A)[sP].[dR](G)[sP].[dR][G)[sP].[dR](T)[sP].[LR](G)[sP].[dR](A)[sP].[dR](C)[sP].[LR](A)[sP].[dR](A)[sP].[dR](C)[sP].[LR](T)[sP].[LR](G) | 1318 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 614 | GGAGGT GACAAC TGGGCC | GGCCCAGTTGTCA CCTCC | SEQ ID 716 | [LR](G)[sP].[dR](G)[sP].[dR](A)[sP].[dR](G)[sP].[LR](G)[sP].[dR](T)[sP][LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[LR]([5meC])[sP].[LR]([5meC]) | 1319 |
| SEQ ID 615 | AGGTGA CAACTG GGCCTG | CAGGCCCAGTTGT CACCT | SEQ ID 717 | [LR](A)[sP].[dR](G)[sP].[dR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[LR](G)[sP].[dR](C)[sP].[dR](C)[sP].[LR](T)[sP].[LR](G) | 1320 |
| SEQ ID 616 | GACAAC TGGGCC TGCACC | GGTGCAGGCCCAG TTGTC | SEQ ID 718 | [LR](G)[sP].[dR](A)[sP].[dR](C)[sP].[LR](A)[sP].[dR][A][sP].[dR](C)[sP].[dR](T)[sP].[LR](G)[sP].[dR](G)[sP].[dR](G)[sP].[dR](C)[sP].[LR]([5meC])[sP].[dR](T)[sP].[LR](G)[sP].[dR](C)[sP].[dR](A)[sP].[LR]([5meC])[sP].[LR]([5meC]) | 1321 |
| SEQ ID 617 | CAACTG GGCCTG CACCTG | CAGGTGCAGGCCC AGTTG | SEQ ID 719 | [LR]([5meC])[sP].[dR](A)[sP].[LR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[dR](G)[sP].[dR](C)[sP].[LR](A)[sP].[dR](C)[sP].[dR](C)[sP].[LR](T)[sP].[LR](G) | 1322 |
| SEQ ID 618 | TGGGCC TGCACC TGCTGC | GCAGCAGGTGCAG GCCCA | SEQ ID 720 | [LR](T)[sP].[dR](G)[sP].[dR](G)[sP].[LR](G)[sP].[dR](C)[sP].[dR](C)[sP].[dR](T)[sP].[LR](G)[sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[LR]([5meC]) | 1323 |
| SEQ ID 619 | GGCCTG CACCTG CTGCAG | CTGCAGCAGGTGC AGGCC | SEQ ID 721 | [LR](G)[sP].[dR](G)[sP].[dR](C)[sP].[LR]([5meC])[sP].[dR](T)[sP].[dR](G)[sP].[dR](C)[sP].[LR](A)[sP].[dR](C)[sP].[dR](C)[sP].[dR](T)[sP].[LR](G)[sP].[dR](C)[sP].[dR](T)[sP].[LR](G)[sP].[dR](C)[sP].[LR](A)[sP].[LR](G) | 1324 |
| SEQ ID 620 | CACCTG CTGCAG AGGTGC | GCACCTCTGCAGCA GGTG | SEQ ID 722 | [LR]([5meC])[sP].[dR](A)[sP].[dR](C)[sP].[dR](C)[sP].[LR](T)[sP].[dR](G)[sP].[dR](C)[sP].[dR](T)[sP].[LR][G)[sP].[dR](C)[sP].[dR](A)[sP].[dR](G)[sP].[LR](A)[sP].[dR](G)[sP].[dR](G)[sP].[dR](T)[sP].[LR](G)[sP].[LR]([5meC]) | 1325 |
| SEQ ID 621 | AGTCTG AGTGCT GCGCAG | GTCCGCAGCACTCA GACT | SEQ ID 723 | [LR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR][G)[sP].[dR](G)[sP].[LR](A)[sP].[LR]([5meC]) | 1326 |
| SEQ ID 622 | TCTGAG TGCTGC GGACTC | GAGTCCGCAGCAC TCAGA | SEQ ID 724 | [LR](T)[sP].[dR](C)[sP].[dR](T)[sP].[LR](G)[sP].[dR][A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[LR](T)[sP].[LR]([5meC]) | 1327 |
| SEQ ID 623 | AGTGCT GCGGAC | TGCTGAGTCCGCA GCACT | SEQ ID 725 | [LR](A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[dR](G)[sP].[LR](A) | 1328 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | TCAGCA | | | [sP].[dR](C)[sP].[dR](T)[sP].[dR](C)[sP].[LR](A)[sP].[dR](G)[sP].[LR]([5meC])[sP].[LR](A) | |
| SEQ ID 624 | TGCTGC GGACTC AGCAGA | TCTGCTGAGTCCG CAGCA | SEQ ID 726 | [LR](T)[sP].[dR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR][C)[sP].[LR](A)[sP].[dR](G)[sP].[dR](C)[sP].[dR](A)[sP].[LR](G)[sP].[LR](A) | 1329 |
| SEQ ID 625 | GCGGAC TCAGCA GACCCG | CGGGTCTGCTGAG TCCGC | SEQ ID 727 | [LR](G)[sP].[dR]([5meC])[sP].[dR][G)[sP].[dR](G)[sP].[LR](A)[sP].[dR](C)[sP].[dR](T)[sP].[dR](C)[sP].[LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[LR](G) | 1330 |
| SEQ ID 626 | GGACTC AGCAGA CCCGGC | GCCGGGTCTGCTG AGTCC | SEQ ID 728 | [LR](G)[sP].[dR](G)[sP].[dR](A)[sP].[dR](C)[sP].[LR](T)[sP].[dR](C)[sP].[dR](A)[sP].[dR](G)[sP].[LR]([5me° C.])[sP].[dR](A)[sP].[dR](G)[sP].[dR](A)[sP].[LR]([5meC])[sP].[dR](C)[sP].[dR]([5meC])[sP].[dR](G)[sP].[LR](G)[sP].[LR]([5meC]) | 1331 |
| SEQ ID 627 | TCAGCA GACCCG GCCACC | GGTGGCCGGGTCT GCTGA | SEQ ID 729 | [LR](T)[sP].[dR](C)[sP].[LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[LR]([5meC])[sP].[LR]([5meC]) | 1332 |
| SEQ ID 628 | GTGTCA CACGCC ACTTAG | CTAAGTGGCGTGT GACAC | SEQ ID 730 | [LR](G)[sP].[dR](T)[sP].[LR](G)[sP].[dR](T)[sP].[dR](C)[sP].[LR](A)[sP].[dR](C)[sP].[dR](A)[sP].[dR](C)[sP].[LR](G)[sP].[dR](C)[sP].[dR](C)[sP].[LR](A)[sP].[dR](C)[sP].[dR](T)[sP].[dR](T)[sP].[LR](A)[sP].[LR](G) | 1333 |
| SEQ ID 629 | GTCACA CGCCAC TTAGGC | GCCTAAGTGGCGT GTGAC | SEQ ID 731 | [LR](G)[sP].[dR](T)[sP].[dR][C)[sP].[LR](A)[sP].[dR](C)[sP].[dR](A)[sP].[dR](C)[sP].[LR](G)[sP].[dR][C)[sP].[dR](C)[sP].[LR](A)[sP].[dR](C)[sP].[LR](T)[sP].[dR](T)[sP].[dR](A)[sP].[dR](G)[sP].[LR](G)[sP].[LR]([5meC]) | 1334 |
| SEQ ID 630 | CACACG CCACTT AGGCTA | TAGCCTAAGTGGC GTGTG | SEQ ID 732 | [LR]([5meC])[sP].[dR](A)[sP].[dR](C)[sP].[LR](A)[sP].[dR](C)[sP].[LR](G)[sP].[dR](C)[sP].[dR](C)[sP].[LR](A)[sP].[dR][C)[sP].[dR](T)[sP].[dR](T)[sP].[LR](A)[sP].[dR](G)[sP].[dR](G)[sP].[dR](C)[sP].[LR](T)[sP].[LR](A) | 1335 |
| SEQ ID 631 | CACGCC ACTTAG GCTACA | TGTAGCCTAAGTG GCGTG | SEQ ID 733 | [LR]([5meC])[sP].[dR](A)[sP].[dR](C)[sP].[LR](G)[sP].[dR](C)[sP].[dR](C)[sP].[LR](A)[sP].[dR](C)[sP].[LR](T)[sP].[dR](T)[sP].[dR](A)[sP].[dR][G)[sP].[LR](G)[sP].[dR](C)[sP].[dR](T)[sP].[dR](A)[sP].[LR]([5meC])[sP].[LR](A) | 1336 |
| SEQ ID 632 | CGCCAC TTAGGC TACAGA | TCTGTAGCCTAAGT GGCG | SEQ ID 734 | [LR]([5meC])[sP].[dR](G)[sP].[dR](C)[sP].[dR](C)[sP].[LR](A)[sP].[dR](C)[sP].[dR](T)[sP].[dR][T)[sP].[LR](A)[sP].[dR](G)[sP].[dR](G)[sP].[dR](C)[sP].[LR](T)[sP].[dR](A)[sP].[dR](C)[sP].[dR](A)[sP].[LR](G)[sP].[LR](A) | 1337 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| SEQ ID 633 | CCACTT AGGCTA CAGAAT | ATTCTGTAGCCTAA GTGG | SEQ ID 735 | [LR]([5meC])[sP].[dR](C)[sP].[dR](A)[sP].[dR](C)[sP].[LR](T)[sP].[dR](T)[sP].[dR](A)[sP].[dR](G)[sP].[LR](G)[sP].[dR](C)[sP].[dR](T)[sP].[dR](A)[sP].[LR]([5meC])[sP].[dR](A)[sP].[dR](G)[sP].[dR](A)[sP].[LR](A)[sP].[LR](T) | 1338 |
| SEQ ID 634 | ACTTAG GCTACA GAATAA | TTATTCTGTAGCCT AAGT | SEQ ID 736 | [LR](A)[sP].[dR](C)[sP].[dR](T)[sP].[dR](T)[sP].[LR](A)[sP].[dR](G)[sP].[dR](G)[sP].[LR]([5meC])[sP].[LR](T)[sP].[dR](A)[sP].[dR](C)[sP].[dR](A)[sP].[LR](G)[sP].[LR](A)[sP].[dR](A)[sP].[dR](T)[sP].[LR](A)[sP].[LR](A) | 1339 |
| SEQ ID 635 | TTAGGC TACAGA ATAAGC | GCTTATTCTGTAGC CTAA | SEQ ID 737 | [LR](T)[sP].[dR](T)[sP].[dR](A)[sP].[dR](G)[sP].[LR](G)[sP].[dR](C)[sP].[dR](T)[sP].[LR](A)[sP].[LR]([5meC])[sP].[dR](A)[sP].[dR](G)[sP].[LR](A)[sP].[dR](A)[sP].[dR](T)[sP].[LR](A)[sP].[dR](A)[sP].[LR](G)[sP].[LR]([5meC]) | 1340 |
| SEQ ID 636 | AGGCTA CAGAAT AAGCTC | GAGCTTATTCTGTA GCCT | SEQ ID 738 | [LR](A)[sP].[dR](G)[sP].[LR](G)[sP].[dR](C)[sP].[dR](T)[sP].[LR](A)[sP].[dR](C)[sP].[dR](A)[sP].[dR](G)[sP].[LR](A)[sP].[LR](A)[sP].[dR](T)[sP].[LR](A)[sP].[dR](A)[sP].[dR](G)[sP].[dR](C)[sP].[LR](T)[sP].[LR]([5meC]) | 1341 |
| SEQ ID 637 | GCTACA GAATAA GCTCTA | TAGAGCTTATTCTG TAGC | SEQ ID 739 | [LR](G)[sP].[dR][C)[sP].[dR](T)[sP].[LR](A)[sP].[dR](C)[sP].[LR](A)[sP].[dR](G)[sP].[LR](A)[sP].[LR](A)[sP].[dR](T)[sP].[dR](A)[sP].[dR](A)[sP].[LR](G)[sP].[dR](C)[sP].[dR](T)[sP].[dR](C)[sP].[LR](T)[sP].[LR](A) | 1342 |
| SEQ ID 638 | TACAGA ATAAGC TCTACC | GGTAGAGCTTATT CTGTA | SEQ ID 740 | [LR](T)[sP].[dR](A)[sP].[dR](C)[sP].[LR](A)[sP].[dR][G)[sP].[dR](A)[sP].[LR](A)[sP].[dR](T)[sP].[dR](A)[sP].[LR](A)[sP].[dR](G)[sP].[dR](C)[sP].[LR](T)[sP].[dR](C)[sP].[dR](T)[sP].[dR](A)[sP].[LR][5meC])[sP].[LR]([5meC]) | 1343 |
| SEQ ID 639 | CAGAAT AAGCTC TACCTC | GAGGTAGAGCTTA TTCTG | SEQ ID 741 | [LR]([5meC])[sP].[dR](A)[sP].[LR](G)[sP].[dR](A)[sP].[dR](A)[sP].[dR](T)[sP].[LR](A)[sP].[dR](A)[sP].[dR](G)[sP].[dR](C)[sP].[LR](T)[sP].[dR](C)[sP].[dR](T)[sP].[dR](A)[sP].[LR]([5meC])[sP].[dR](C)[sP].[LR](T)[sP].[LR]([5meC]) | 1344 |
| SEQ ID 640 | GAATAA GCTCTA CCTCAG | CTGAGGTAGAGCT TATTC | SEQ ID 742 | [LR](G)[sP].[dR](A)[sP].[dR](A)[sP].[dR](T)[sP].[LR](A)[sP].[dR](A)[sP].[dR](G)[sP].[dR](C)[sP].[LR](T)[sP].[dR](C)[sP].[LR](T)[sP].[dR](A)[sP].[dR](C)[sP].[dR](C)[sP].[LR](T)[sP].[dR](C)[sP].[LR](A)[sP].[LR](G) | 1345 |
| SEQ ID 641 | ATAAGC TCTACC TCAGAA | TTCTGAGGTAGAG CTTAT | SEQ ID 743 | [LR](A)[sP].[dR](T)[sP].[dR](A)[sP].[LR](A)[sP].[dR](G)[sP].[dR](C)[sP].[LR](T)[sP].[dR](C)[sP].[dR](T)[sP].[LR](A)[sP].[dR](C)[sP].[LR]([5meC])[sP].[dR](T)[sP].[dR](C)[sP].[LR](A)[sP].[dR](G)[sP].[LR](A)[sP].[LR](A) | 1346 |
| SEQ ID 642 | AAGCTC TACCTC | GATTCTGAGGTAG AGCTT | SEQ ID 744 | [LR](A)[sP].[dR](A)[sP].[dR](G)[sP].[dR](C)[sP].[LR](T)[sP].[dR](C)[sP].[dR](T)[sP].[LR](A)[sP].[dR](C)[sP].[dR](C)[sP].[LR](T)[sP].[dR] | 1347 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | AGAATC | | | (C)[sP].[dR](A)[sP].[dR](G)[sP].[LR](A)[sP].[dR](A)[sP].[LR](T)[sP].[LR]([5meC]) | |
| SEQ ID 643 | GCTCTA CCTCAG AATCTG | CAGATTCTGAGGTA GAGC | SEQ ID 745 | [LR](G)[sP].[dR](C)[sP].[LR](T)[sP].[dR](C)[sP].[dR](T)[sP].[LR](A)[sP].[dR](C)[sP].[dR](C)[sP].[dR](T)[sP].[LR]([5meC])[sP].[dR](A)[sP].[dR](G)[sP].[dR](A)[sP].[LR](A)[sP].[dR](T)[sP].[dR](C)[sP].[LR](T)[sP].[LR](G) | 1348 |
| SEQ ID 644 | TCTACC TCAGAA TCTGAA | TTCAGATTCTGAGG TAGA | SEQ ID 746 | [LR](T)[sP].[dR](C)[sP].[dR](T)[sP].[LR](A)[sP].[dR](C)[sP].[dR](C)[sP].[LR](T)[sP].[LR]([5meC])[sP].[dR](A)[sP].[dR](G)[sP].[dR](A)[sP].[LR](A)[sP].[dR](T)[sP].[LR]([5meC])[sP].[dR](T)[sP].[dR](G)[sP].[LR](A)[sP].[LR](A) | 1349 |
| SEQ ID 645 | TACCTC AGAATC TGAAGA | TCTTCAGATTCTGA GGTA | SEQ ID 747 | [LR](T)[sP].[dR](A)[sP].[dR](C)[sP].[dR](C)[sP].[LR](T)[sP].[dR](C)[sP].[LR](A)[sP].[dR](G)[sP].[LR](A)[sP].[LR](A)[sP].[dR](T)[sP].[dR](C)[sP].[dR](T)[sP].[LR](G)[sP].[dR](A)[sP].[dR](A)[sP].[LR](G)[sP].[LR](A) | 1350 |
| SEQ ID 646 | CCTCAG AATCTG AAGAGG | CCTCTTCAGATTCT GAGG | SEQ ID 748 | [LR]([5meC])[sP].[dR](C)[sP].[dR](T)[sP].[dR](C)[sP].[LR](A)[sP].[dR](G)[sP].[dR](A)[sP].[dR][A][sP].[LR](T)[sP].[dR](C)[sP].[dR](T)[sP].[dR](G)[sP].[LR](A)[sP].[dR](A)[sP].[dR](G)[sP].[dR](A)[sP].[LR](G)[sP].[LR](G) | 1351 |
| SEQ ID 647 | TCAGAA TCTGAA GAGGCA | TGCCTCTTCAGATT CTGA | SEQ ID 749 | [LR](T)[sP].[dR][C)[sP].[dR](A)[sP].[dR](G)[sP].[LR](A)[sP].[LR](A)[sP].[dR](T)[sP].[dR](C)[sP].[dR](T)[sP].[LR](G)[sP].[dR](A)[sP].[dR](A)[sP].[LR](G)[sP].[dR](A)[sP].[dR](G)[sP].[dR](G)[sP].[LR]([5meC])[sP].[LR](A) | 1352 |
| SEQ ID 648 | AGAATC TGAAGA GGCAAC | GTTGCCTCTTCAGA TTCT | SEQ ID 750 | [LR](A)[sP].[dR](G)[sP].[dR](A)[sP].[LR](A)[sP].[dR](T)[sP].[LR][5meC])[sP].[dR](T)[sP].[dR](G)[sP].[dR][A)[sP].[LR](A)[sP].[LR](G)[sP].[dR](A)[sP].[dR][G)[sP].[dR](G)[sP].[LR]([5meC])[sP].[dR](A)[sP].[LR](A)[sP].[LR]([5meC]) | 1353 |
| SEQ ID 649 | AATCTG AAGAGG CAACAG | CTGTTGCCTCTTCA GATT | SEQ ID 751 | [LR](A)[sP].[dR](A)[sP].[LR](T)[sP].[dR](C)[sP].[LR](T)[sP].[dR](G)[sP].[LR](A)[sP].[dR](A)[sP].[dR](G)[sP].[dR](A)[sP].[LR](G)[sP].[dR](G)[sP].[dR](C)[sP].[LR](A)[sP].[LR](A)[sP].[dR](C)[sP].[LR](A)[sP].[LR](G) | 1354 |
| SEQ ID 650 | TCTGAA GAGGCA ACAGTG | CACTGTTGCCTCTT CAGA | SEQ ID 752 | [LR](T)[sP].[dR](C)[sP].[dR](T)[sP].[LR](G)[sP].[dR](A)[sP].[dR](A)[sP].[dR](G)[sP].[LR](A)[sP].[dR](G)[sP].[dR](G)[sP].[dR](C)[sP].[LR](A)[sP].[dR](A)[sP].[dR][C][sP].[LR](A)[sP].[dR](G)[sP].[LR](T)[sP].[LR](G) | 1355 |
| SEQ ID 651 | TGAAGA GGCAAC AGTGTC | GACACTGTTGCCT CTTCA | SEQ ID 753 | [LR](T)[sP].[dR](G)[sP].[LR](A)[sP].[dR](A)[sP].[dR](G)[sP].[LR](A)[sP].[dR](G)[sP].[dR](G)[sP].[dR](C)[sP].[LR](A)[sP].[dR](A)[sP].[dR](C)[sP].[LR](A)[sP].[dR](G)[sP].[dR](T)[sP].[dR](G)[sP].[LR](T)[sP].[LR]([5meC]) | 1356 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 652 | AAGAGG CAACAG TGTCAG | CTGACACTGTTGC CTCTT | SEQ ID 754 | [LR](A)[sP].[dR](A)[sP].[dR](G)[sP].[LR](A)[sP].[dR](G)[sP].[dR](G)[sP].[dR](C)[sP].[LR](A)[sP].[dR](A)[sP].[dR](C)[sP].[LR](A)[sP].[dR](G)[sP].[dR](T)[sP].[LR](G)[sP].[dR](T)[sP].[dR](C)[sP].[LR](A)[sP].[LR](G) | 1357 |
| SEQ ID 653 | GAGGCA ACAGTG TCAGAG | CTCTGACACTGTTG CCTC | SEQ ID 755 | [LR](G)[sP].[dR](A)[sP].[dR](G)[sP].[dR][G)[sP].[LR]([5meC])[sP].[dR](A)[sP].[dR](A)[sP].[dR](C)[sP].[LR](A)[sP].[dR](G)[sP].[dR](T)[sP].[dR](G)[sP].[LR](T)[sP].[dR](C)[sP].[dR](A)[sP].[dR](G)[sP].[LR](A)[sP].[LR](G) | 1358 |
| SEQ ID 654 | GGCAAC AGTGTC AGAGTC | GACTCTGACACTCT GTTGCC | SEQ ID 756 | [LR](G)[sP].[dR](G)[sP].[dR](C)[sP].[LR](A)[sP].[dR](A)[sP].[dR](C)[sP].[LR](A)[sP].[dR](G)[sP].[dR](T)[sP].[LR](G)[sP].[dR](T)[sP].[dR](C)[sP].[LR](A)[sP].[dR](G)[sP].[dR](A)[sP].[dR](G)[sP].[LR](T)[sP].[LR]([5meC]) | 1359 |
| SEQ ID 655 | CAACAG TGTCAG AGTCCA | TGGACTCTGACACT GTTG | SEQ ID 757 | [LR]([5meC])[sP].[dR](A)[sP].[dR](A)[sP].[dR](C)[sP].[LR](A)[sP].[dR](G)[sP].[dR](T)[sP].[LR][G)[sP].[dR](T)[sP].[dR](C)[sP].[LR](A)[sP].[dR](G)[sP].[dR][A)[sP].[dR](G)[sP].[LR](T)[sP].[dR](C)[sP].[LR]([5meC])[sP].[LR](A) | 1360 |
| SEQ ID 656 | ACAGTG TCAGAG TCCATG | CATGGACTCTGACA CTGT | SEQ ID 758 | [LR](A)[sP].[dR](C)[sP].[LR](A)[sP].[dR](G)[sP].[dR](T)[sP].[LR](G)[sP].[dR](T)[sP].[dR](C)[sP].[LR](A)[sP].[dR](G)[sP].[dR](A)[sP].[dR](G)[sP].[LR](T)[sP].[dR][C)[sP].[dR](C)[sP].[dR](A)[sP].[LR](T)[sP].[LR](G) | 1361 |
| SEQ ID 657 | AGTGTC AGAGTC CATGGG | CCCATGGACTCTGA CACT | SEQ ID 759 | [LR](A)[sP].[dR](G)[sP].[dR](T)[sP].[LR](G)[sP].[dR][T)[sP].[dR](C)[sP].[LR](A)[sP].[dR](G)[sP].[dR](A)[sP].[dR](G)[sP].[LR](T)[sP].[dR](C)[sP].[dR](C)[sP].[LR](A)[sP].[dR](T)[sP].[dR][G)[sP].[LR](G)[sP].[LR](G) | 1362 |
| SEQ ID 658 | TGTCAG AGTCCA TGGGAA | TTCCCATGGACTCT GACA | SEQ ID 760 | [LR](T)[sP].[dR](G)[sP].[dR](T)[sP].[dR](C)[sP].[LR](A)[sP].[dR](G)[sP].[dR](A)[sP].[dR](G)[sP].[LR](T)[sP].[dR](C)[sP].[dR](C)[sP].[LR](A)[sP].[dR](T)[sP].[LR](G)[sP].[dR](G)[sP].[dR](G)[sP].[LR](A)[sP].[LR](A) | 1363 |
| SEQ ID 659 | TCAGAG TCCATG GGAAGA | TCTTCCCATGGACT CTGA | SEQ ID 761 | [LR](T)[sP].[dR](C)[sP].[LR](A)[sP].[dR](G)[sP].[dR](A)[sP].[dR](G)[sP].[LR](T)[sP].[dR](C)[sP].[dR](C)[sP].[LR](A)[sP].[dR](T)[sP].[dR](G)[sP].[dR](G)[sP].[LR](G)[sP].[dR](A)[sP].[dR](A)[sP].[LR](G)[sP].[LR](A) | 1364 |
| SEQ ID 660 | AGAGTC CATGGG AAGATG | CATCTTCCCATGGA CTCT | SEQ ID 762 | [LR](A)[sP].[dR](G)[sP].[dR](A)[sP].[dR](G)[sP].[LR](T)[sP].[dR](C)[sP].[dR](C)[sP].[LR][A][sP].[dR](T)[sP].[LR](G)[sP].[dR][G)[sP].[dR](G)[sP].[LR](A)[sP].[dR](A)[sP].[dR](G)[sP].[dR](A)[sP].[LR](T)[sP].[LR](G) | 1365 |
| SEQ ID 661 | AGTCCA TGGGAA | AACATCTTCCCATG GACT | SEQ ID 763 | [LR](A)[sP].[dR](G)[sP].[LR](T)[sP].[dR](C)[sP].[dR](C)[sP].[LR](A)[sP].[dR](T)[sP].[dR](G)[sP].[dR][G)[sP].[LR][G)[sP].[dR](A)[sP].[dR] | 1366 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | GATGTT | | | (A)[sP].[dR](G)[sP].[LR](A)[sP].[dR](T)[sP].[dR](G)[sP].[LR](T)[sP].[LR](T) | |
| SEQ ID 662 | TGCTGC AGAGGT GCACAT | ATGTGCACCTCTG CAGCA | SEQ ID 764 | [LR](T)[sP].[dR](G)[sP].[dR][C)[sP].[dR](T)[sP].[LR](G)[sP].[dR](C)[sP].[dR](A)[sP].[dR](G)[sP].[LR](A)[sP].[dR][G)[sP].[dR](G)[sP].[dR](T)[sP].[LR](G)[sP].[dR](C)[sP].[dR](A)[sP].[dR](C)[sP].[LR](A)[sP].[LR](T) | 1367 |
| SEQ ID 663 | CTGCAG AGGTGC ACATAG | CTATGTGCACCTCT GCAG | SEQ ID 765 | [LR]([5meC][sP].[dR](T)[sP].[dR](G)[sP].[dR](C)[sP].[LR](A)[sP].[dR](G)[sP].[dR](A)[sP].[dR](G)[sP].[LR][G)[sP].[dR](T)[sP].[dR](G)[sP].[dR](C)[sP].[LR](A)[sP].[dR](C)[sP].[dR](A)[sP].[dR](T)[sP].[LR](A)[sP].[LR](G) | 1368 |
| SEQ ID 664 | GCAGAG GTGCAC ATAGTC | GACTATGTGCACCT CTGC | SEQ ID 766 | [LR](G)[sP].[dR](C)[sP].[dR][A)[sP].[dR](G)[sP].[LR](A)[sP].[dR](G)[sP].[dR](G)[sP].[dR](T)[sP].[LR](G)[sP].[dR](C)[sP].[dR](A)[sP].[dR](C)[sP].[LR](A)[sP].[dR](T)[sP].[dR](A)[sP].[dR](G)[sP].[LR](T)[sP].[LR]([5meC]) | 1369 |
| SEQ ID 665 | AGAGGT GCACAT AGTCTG | CAGACTATGTGCA CCTCT | SEQ ID 767 | [LR](A)[sP].[dR](G)[sP].[dR](A)[sP].[dR](G)[sP].[LR](G)[sP].[dR](T)[sP].[dR](G)[sP].[dR](C)[sP].[LR](A)[sP].[dR](C)[sP].[dR](A)[sP].[dR](T)[sP].[LR](A)[sP].[dR](G)[sP].[dR](T)[sP].[dR](C)[sP].[LR](T)[sP].[LR](G) | 1370 |
| SEQ ID 666 | AGGTGC ACATAG TCTGAG | CTCAGACTATGTGC ACCT | SEQ ID 768 | [LR](A)[sP].[dR](G)[sP][dR](G)[sP].[dR](T)[sP].[LR][G][sP].[dR](C)[sP].[dR](A)[sP].[dR](C)[sP].[LR](A)[sP].[dR](T)[sP].[dR](A)[sP].[dR](G)[sP].[LR](T)[sP].[dR](C)[sP].[dR](T)[sP].[dR](G)[sP].[LR](A)[sP].[LR](G) | 1371 |
| SEQ ID 667 | GTGCAC ATAGTC TGAGTG | CACTCAGACTATGT GCAC | SEQ ID 769 | [LR](G)[sP].[dR](T)[sP].[dR](G)[sP].[dR](C)[sP].[LR](A)[sP].[dR](C)[sP].[LR](A)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[LR](T)[sP].[LR](G) | 1372 |
| SEQ ID 668 | GCACAT AGTCTG AGTGCT | AGCACTCAGACTAT GTGC | SEQ ID 770 | [LR](G)[sP].[dR](C)[sP].[dR](A)[sP].[dR](C)[sP].[LR](A)[sP].[dR](T)[sP].[dR](A)[sP].[dR](G)[sP].[LR](T)[sP].[dR](C)[sP].[dR](T)[sP].[dR](G)[sP].[LR](A)[sP].[dR](G)[sP].[dR](T)[sP].[dR](G)[sP].[LR]([5meC])[sP].[LR](T) | 1373 |
| SEQ ID 669 | ACATAG TCTGAG TGCTGC | GCAGCACTCAGAC TATGT | SEQ ID 771 | [LR](A)[sP].[dR](C)[sP].[LR](A)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP][LR](G)[sP].[LR]([5meC]) | 1374 |
| SEQ ID 670 | ATAGTC TGAGTG CTGCGG | CCGCAGCACTCAG ACTAT | SEQ ID 772 | [LR](A)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR](C)[sP].[LR](G)[sP].[LR](G) | 1375 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 671 | AGCAGA CCCGGC CACCAG | CTGGTGGCCGGGT CTGCT | SEQ ID 773 | [LR](A)[sP].[dR](G)[sP].[dR](C)[sP].[dR](A)[sP].[LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[dR][C)[sP].[dR](C)[sP].[LR](A)[sP].[LR](G) | 1376 |
| SEQ ID 672 | CAGACC CGGCCA CCAGCC | GGCTGGTGGCCGG GTCTG | SEQ ID 774 | [LR]([5meC])[sP].[dR](A)[sP].[dR][G)[sP].[LR](A)[sP].[dR](C)[sP].[dR](C)[sP].[dR](C)[sP].[LR](CCAGCCG)[sP].[dR](G)[sP].[dR](C)[sP].[dR](C)[sP].[LR](A)[sP].[dR](C)[sP].[dR](C)[sP].[LR](A)[sP].[dR](G)[sP].[LR]([5meC])[sP].[LR]([5meC]) | 1377 |
| SEQ ID 673 | GACCCG GCCACC AGCCTT | AAGGCTGGTGGCC GGGTC | SEQ ID 775 | [LR](G)[sP].[dR](A)[sP].[dR](C)[sP].[dR](C)[sP].[LR]([5meC])[sP].[dR](G)[sP].[dR](G)[sP].[dR](C)[sP].[LR]([5meC])[sP].[dR](A)[sP].[dR](C)[sP].[dR](C)[sP].[LR](A)[sP].[dR](G)[sP].[dR](C)[sP].[dR](C)[sP].[LR](T)[sP].[LR](T) | 1378 |
| SEQ ID 674 | CCCGGC CACCAG CCTTAC | GTAAGGCTGGTGG CCGGG | SEQ ID 776 | [LR]([5meC])[sP].[dR](C)[sP].[dR](C)[sP].[LR](G)[sP].[dR](G)[sP].[dR](C)[sP].[dR](C)[sP].[LR](A)[sP].[dR](C)[sP].[dR][C)[sP].[LR](A)[sP].[dR](G)[sP].[dR](C)[sP].[dR](C)[sP].[LR](T)[sP].[dR](T)[sP].[LR](A)[sP].[LR]([5meC]) | 1379 |
| SEQ ID 675 | CGGCCA CCAGCC TTACTC | GAGTAAGGCTGGT GGCCG | SEQ ID 777 | [LR]([5meC])[sP].[dR](G)[sP].[dR](G)[sP].[dR](C)[sP].[LR]([5meC])[sP].[dR](A)[sP].[dR](C)[sP].[dR](C)[sP].[LR][A)[sP].[dR][G)[sP].[dR](C)[sP].[dR](C)[sP].[LR](T)[sP].[dR](T)[sP].[dR](A)[sP].[dR](C)[sP].[LR](T)[sP].[LR]([5meC]) | 1380 |
| SEQ ID 676 | GCCACC AGCCTT ACTCCA | TGGAGTAAGGCTG GTGGC | SEQ ID 778 | [LR](G)[sP].[dR](C)[sP].[dR](C)[sP].[LR](A)[sP].[dR](C)[sP].[dR](C)[sP].[LR](A)[sP].[dR](G)[sP].[dR](C)[sP].[dR](C)[sP].[LR](T)[sP].[dR](T)[sP].[LR](A)[sP].[dR](C)[sP].[dR](T)[sP].[dR](C)[sP].[LR]([5meC])[sP].[LR](A) | 1381 |
| SEQ ID 677 | CACCAG CCTTAC TCCACT | AGTGGAGTAAGGC TGGTG | SEQ ID 779 | [LR]([5meC][sP].[dR](A)[sP].[dR](C)[sP].[dR](C)[sP].[LR](A)[sP].[dR](G)[sP].[dR](C)[sP].[dR][C)[sP].[LR](T)[sP].[dR](T)[sP].[dR](A)[sP].[dR](C)[sP].[LR](T)[sP].[dR][C)[sP].[dR](C)[sP].[dR](A)[sP].[LR]([5meC])[sP].[LR](T) | 1382 |
| SEQ ID 678 | CCAGCC TTACTC CACTCC | GGAGTGGAGTAAG GCTGG | SEQ ID 780 | [LR]([5meC])[sP].[dR](C)[sP].[dR](A)[sP].[dR][G)[sP].[LR]([5meC])[sP].[dR](C)[sP].[dR](T)[sP].[dR](T)[sP].[LR](A)[sP].[dR](C)[sP].[dR](T)[sP].[dR](C)[sP].[LR]([5meC])[sP].[dR](A)[sP].[dR](C)[sP].[dR](T)[sP].[LR]([5meC])[sP].[LR]([5meC]) | 1383 |
| SEQ ID 679 | AGCCTT ACTCCA CTCCCC | GGGGAGTGGAGTA AGGCT | SEQ ID 781 | [LR](A)[sP].[dR](G)[sP].[dR](C)[sP].[dR](C)[sP].[LR](T)[sP].[dR](T)[sP].[dR](A)[sP].[dR](C)[sP].[LR](T)[sP].[dR](C)[sP].[dR](C)[sP].[LR](A)[sP].[dR](C)[sP].[LR](T)[sP].[dR](C)[sP].[dR](C)[sP].[LR]([5meC])[sP].[LR]([5meC]) | 1384 |
| SEQ ID 680 | CCTTAC TCCACT | CAGGGGAGTGGA GTAAGG | SEQ ID 782 | [LR]([5meC])[sP].[dR](C)[sP].[dR](T)[sP].[dR](T)[sP].[LR](A)[sP].[dR](C)[sP].[dR](T)[sP].[dR](C)[sP].[LR]([5meC])[sP].[dR](A)[sP].[dR] | 1385 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| | CCCCTG | | | (C)[sP].[dR](T)[sP].[LR]([5meC])[sP].[dR](C)[sP].[dR](C)[sP].[dR](C)[sP].[LR](T)[sP].[LR](G) | |
| SEQ ID 681 | TTACTC CACTCC CCTGGA | TCCAGGGGAGTGG AGTAA | SEQ ID 783 | [LR](T)[sP].[dR](T)[sP].[dR](A)[sP].[dR](C)[sP].[LR](T)[sP].[dR](C)[sP].[dR](C)[P].[LR](A)[sP].[dR](C)[sP].[LR](T)[sP].[dR](C)[sP].[dR](C)[sP].[LR]([5meC])[sP].[dR](C)[sP].[dR](T)[sP].[dR](G)[sP].[LR](G)[sP].[LR](A) | 1386 |
| SEQ ID 682 | ACTCCA CTCCCC TGGAAG | CTTCCAGGGGAGT GGAGT | SEQ ID 784 | [LR](A)[sP].[dR](C)[sP].[LR](T)[sP].[dR](C)[sP].[dR](C)[sP].[LR](A)[sP].[dR](C)[sP].[dR](T)[sP].[dR](C)[sP].[LR]([5meC])[sP].[dR](C)[sP].[dR](C)[sP].[dR](T)[sP].[LR](G)[sP].[dR](G)[sP].[dR](A)[sP].[LR](A)[sP].[LR](G) | 1387 |
| SEQ ID 683 | TCCACT CCCCTG GAAGGA | TCCTTCCAGGGGA GTGGA | SEQ ID 785 | [LR](T)[sP].[dR](C)[sP].[dR](C)[sP].[LR](A)[sP].[dR](C)[sP].[LR](T)[sP].[dR](C)[sP].[dR](C)[sP].[dR](C)[sP].[LR]([5meC])[sP].[dR](T)[sP].[dR](G)[sP].[dR](G)[sP].[LR](A)[sP].[dR](A)[sP].[dR](G)[sP].[LR](G)[sP].[LR](A) | 1388 |
| SEQ ID 684 | CACTCC CCTGGA AGGAAA | TTTCCTTCCAGGGG AGTG | SEQ ID 786 | [LR]([5meC])[sP].[dR](A)[sP].[dR](C)[sP].[dR](T)[sP].[LR]([5meC])[sP].[dR](C)[sP].[dR](C)[sP].[dR](C)[sP].[LR](T)[sP].[dR](G)[sP].[dR](G)[sP].[dR](A)[sP].[LR](A)[sP].[dR](G)[sP].[dR](G)[sP].[dR](A)[sP].[LR](A)[sP].[LR](A) | 1389 |
| SEQ ID 685 | CTCCCC TGGAAG GAAAGA | TCTTTCCTTCCAGG GGAG | SEQ ID 787 | [LR]([5meC])[sP].[dR](T)[sP].[dR](C)[sP].[dR](C)[sP].[LR]([5meC])[sP].[dR](C)[sP].[dR](T)[sP].[dR](G)[sP].[LR](G)[sP].[dR](A)[sP].[dR](A)[sP].[dR](G)[sP].[LR](G)[sP].[dR](A)[sP].[dR](A)[sP].[dR](A)[sP].[LR](G)[sP].[LR](A) | 1390 |
| SEQ ID 686 | CCCCTG GAAGGA AAGACC | GGTCTTTCCTTCCA GGGG | SEQ ID 788 | [LR]([5meC])[sP].[dR](C)[sP].[dR](C)[sP].[dR](C)[sP].[LR](T)[sP].[dR](G)[sP].[dR](G)[sP].[dR](A)[sP].[LR](A)[sP].[dR](G)[sP].[dR](G)[sP].[dR](A)[sP].[LR](A)[sP].[dR](A)[sP].[dR](G)[sP].[dR](A)[sP].[LR]([5meC])[sP].[LR]([5meC]) | 1391 |
| SEQ ID 687 | CCTGGA AGGAAA GACCAC | GTGGTCTTTCCTTC CAGG | SEQ ID 789 | [LR]([5meC])[sP].[dR](C)[sP].[dR](T)[sP].[dR](G)[sP].[LR](G)[sP].[dR](A)[sP].[dR](A)[sP].[dR](G)[sP].[LR](G)[sP].[dR](A)[sP].[dR](A)[sP].[dR](A)[sP].[LR](G)[sP].[dR](A)[sP].[dR](C)[sP].[dR](C)[sP].[LR](A)[sP].[LR]([5meC]) | 1392 |
| SEQ ID 688 | TGGAAG GAAAGA CCACAG | CTGTGGTCTTTCCT TCCA | SEQ ID 790 | [LR](T)[sP].[dR](G)[sP].[dR](G)[sP].[dR](A)[sP].[LR](A)[sP].[dR](G)[sP].[dR](G)[sP].[dR][A)[sP].[LR](A)[sP].[dR][A)[sP].[LR](G)[sP].[dR](A)[sP].[LR]([5meC][sP].[dR](C)[sP].[dR](A)[sP].[dR](C)[sP].[LR](A)[sP].[LR](G) | 1393 |
| SEQ ID 689 | GAAGGA AAGACC ACAGTG | CACTGTGGTCTTTC CTTC | SEQ ID 791 | [LR](G)[sP].[dR](A)[sP].[dR](A)[sP].[dR](G)[sP].[LR](G)[sP].[dR](A)[sP].[dR](A)[sP].[dR](A)[sP].[LR](G)[sP].[dR](A)[sP].[LR]([5meC])[sP].[dR](C)[sP].[dR](A)[sP].[dR](C)[sP].[LR](A)[sP].[dR](G)[sP].[LR](T)[sP].[LR](G) | 1394 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 690 | AGGAAA GACCAC AGTGAG | CTCACTGTGGTCTT TCCT | SEQ ID 792 | [LR](A)[sP].[dR](G)[sP].[dR](G)[sP].[dR](A)[sP].[LR](A)[sP].[dR](A [sP].[dR](G)[sP].[LR](A)[sP].[dR](C)[sP].[dR](C)[sP].[LR](A)[sP].[dR] (C)[sP].[LR](A)[sP].[dR](G)[sP].[dR](T)[sP].[dR](G)[sP].[LR](A)[sP]. [LR](G) | 1395 |
| SEQ ID 691 | GAAAGA CCACAG TGAGTA | TACTCACTGTGGTC TTTC | SEQ ID 793 | [LR](G)[sP].[dR](A)[sP].[LR](A)[sP].[dR](A)[sP].[LR](G)[sP].[dR](A) [sP].[dR](C)[sP].[dR](C)[sP].[LR](A)[sP].[dR](C)[sP].[dR](A)[sP].[dR] (G)[sP].[LR](T)[sP].[dR](G)[sP].[dR](A)[sP].[dR](G)[sP].[LR](T)[sP]. [LR](A) | 1396 |
| SEQ ID 692 | AAGACC ACAGTG AGTAAA | TTTACTCACTGTGG TCTT | SEQ ID 794 | [LR](A)[sP].[dR](A)[sP].[dR](G)[sP].[LR](A)[sP].[dR](C)[sP].[dR](C) [sP].[LR](A)[sP].[LR]([5meC])[sP].[dR](A)[sP].[dR](G)[sP].[LR](T)[sP]. [dR](G)[sP].[LR](A)[sP].[dR](G)[sP].[LR](T)[sP].[dR](A)[sP].[LR] (A)[sP].[LR](A) | 1397 |
| SEQ ID 693 | GACCAC AGTGAG TAAAAG | CTTTTACTCACTGT GGTC | SEQ ID 795 | [LR](G)[sP].[dR](A)[sP].[LR]([5meC])[sP].[dR][C)[sP].[dR](A)[sP]. [LR]([5meC])[sP].[dR](A)[sP].[dR][G)[sP].[dR](T)[sP].[LR](G)[sP].[dR] (A)[sP].[dR](G)[sP].[LR](T)[sP].[LR](A)[sP].[dR](A)[sP].[dR](A)[sP]. [LR](A)[sP].[LR](G) | 1398 |
| SEQ ID 694 | CCACAG TGAATA AAAGTT | AACTTTTACTCACT GTGG | SEQ ID 796 | [LR]([5meC])[sP].[dR](C)[sP].[dR](A)[sP].[dR][C)[sP].[LR](A)[sP]. [dR](G)[sP].[dR](T)[sP].[LR](G)[sP].[dR](A)[sP].[LR](G)[sP].[dR](T) [sP].[dR](A)[sP].[LR](A)[sP].[dR](A)[sP].[dR](A)[sP].[LR](G)[sP].[LR] (T)[sP].[LR](T) | 1399 |
| SEQ ID 695 | ACAGTG AGTAAA AGTTGC | GCAACTTTTACTCA CTGT | SEQ ID 797 | [LR](A)[sP].[dR](C)[sP].[LR](A)[sP].[dR](G)[sP].[dR](T)[sP].[LR](G) [sP].[dR](A)[sP].[dR](G)[sP].[LR](T)[sP].[LR](A)[sP].[dR](A)[sP].[dR] (A)[sP].[dR](A)[sP].[LR](G)[sP].[dR](T)[sP].[dR](T)[sP].[LR](G)[sP]. [LR]([5meC]) | 1400 |
| SEQ ID 696 | AGTGAG TAAAAG TTGCCA | TGGCAACTTTTACT CACT | SEQ ID 798 | [LR](A)[sP].[dR](G)[sP].[dR](T)[sP].[dR](G)[sP].[LR](A)[sP].[dR](G) [sP].[dR](T)[sP].[dR](A)[sP].[LR](A)[sP].[dR][A][sP].[dR](A)[sP].[dR] (G)[sP].[LR](T)[sP].[dR](T)[sP].[dR](G)[sP].[dR](C)[sP].[LR]([5meC]) [sP].[LR](A) | 1401 |
| SEQ ID 697 | TGAGTA AAAGTT GCCAAG | CTTGGCAACTTTTA CTCA | SEQ ID 799 | [LR](T)[sP].[LR](G)[sP].[dR](A)[sP].[LR](G)[sP].[dR](T)[sP].[dR](A) [sP].[LR](A)[sP].[LR](A)[sP].[dR](A)[sP].[dR](G)[sP].[LR](T)[sP].[dR] (T)[sP].[LR](G)[sP].[dR](C)[sP].[dR](C)[sP].[dR](A)[sP].[LR](A)[sP]. [LR](G) | 1402 |
| SEQ ID 698 | AGTAAA AGTTGC CAAGGA | TCCTTGGCAACTTT TACT | SEQ ID 800 | [LR](A)[sP].[dR](G)[sP].[dR](T)[sP].[dR](A)[sP].[LR](A)[sP].[LR](A) [sP].[dR](A)[sP].[dR](G)[sP].[dR](T)[sP].[LR](T)[sP].[dR](G)[sP].[dR] (C)[sP].[LR]([5meC])[sP].[dR](A)[sP].[dR](A)[sP].[dR](G)[sP].[LR] (G)[sP].[LR](A) | 1403 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| HUMAN | | | | | |
| SEQ ID 808 | ACAACT GGGCCT GCACCT | AGGTGCAGGCCCA GTTGT | SEQ ID 901 | [LR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR][T][sP].[dR](G)[sP][dR](C)[sP].[LR](A)[sP].[dR](C)[sP].[LR]([5meC])[sP].[LR](T)} | 1404 |
| SEQ ID 809 | GGGCCT GCACCT GCTGCA | TGCAGCAGGTGCA GTTGT | SEQ ID 902 | [LR](G)[sP].[dR](G)[sP].[dR](G)[sP].[dR](C)[sP].[LR]([5meC])[sP].[dR](T)[sP].[dR](G)[sP].[dR](C)[sP].[LR](A)[sP].[dR][C][sP].[dR](C)[sP].[dR](T)[sP].[LR](G)[sP].[dR](C)[sP].[dR](T)[sP].[dR](G)[sP].[LR]([5meC])[sP].[LR](A)} | 1405 |
| SEQ ID 810 | GCACCT GCTGCA GAGGTG | CACCTCTGCAGCA GGTGC | SEQ ID 903 | [LR](G)[sP].[dR][C][sP].[LR](A)[sP].[dR][C][sP].[dR][C)[sP].[dR][T)[sP].[LR](G)[sP].[dR][C][sP].[dR](T)[sP].[LR](G)[sP].[dR][C][sP].[dR](A)[sP].[LR][G)[sP].[dR](A)[sP].[dR](G)[sP].[dR](G)[sP].[LR](T)[sP].[LR](G)} | 1406 |
| SEQ ID 811 | GAGGTG CACGTA GTCTGA | TCAGACTACGTGCA CCTC | SEQ ID 904 | [LR](G)[sP].[dR](A)[sP].[dR](G)[sP].[LR](G)[sP].[dR](T)[sP].[dR][G)[sP].[dR](C)[sP].[LR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR](G)[sP].[LR](A)} | 1407 |
| SEQ ID 812 | CACGTA GTCTGA GTGCTG | CAGCACTCAGACTA CGTG | SEQ ID 905 | [LR]([5meC])[sP].[dR](A)[sP].[dR](C)[sP].[LR](G)[sP].[dR](T)[sP].[dR](A)[sP].[dR](G)[sP].[LR](T)[sP].[BR](C)[sP].[dR](T)[sP].[LR](G)[sP].[dR](A)[sP].[dR](G)[sP].[dR](T)[sP].[LR](G)[sP].[dR](C)[sP].[LR](T)[sP].[LR](G)} | 1408 |
| SEQ ID 813 | GTCTGA GTGCTG CGGACT | AGTCCGCAGCACT CAGAC | SEQ ID 906 | [LR](G)[sP].[dR](T)[sP].[dR](C)[sP].[dR](T)[sP].[LR](G)[sP].[dR](A)[sP].[dR](G)[sP].[dR](T)[sP].[LR](G)[sP].[dR](C)[sP].[dR](T)[sP].[dR][G)[sP].[LR]([5meC])[sP].[dR](G)[sP].[dR](G)[sP].[dR](A)[sP].[LR]([5meC])[sP].[LR](T)} | 1409 |
| SEQ ID 814 | GTGCTG CGGACT CAGCAG | CTGCTGAGTCCGCA GCGC | SEQ ID 907 | [LR](G)[sP][dR](T)[sP].[LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR](C)[sP].[LR](A)[sP].[dR](G)[sP].[dR](C)[sP].[LR](A)[sP].[LR](G)} | 1410 |
| SEQ ID 815 | CGGACT CAGCAG ACCGCC | CCGGGTCTGCTGA GTCCG | SEQ ID 908 | [LR]([5meC][sP].[dR](G)[sP].[dR](G)[sP].[LR](A)[sP].[dR](C)[sP].[dR][T][sP].[dR](C)[sP].[LR](A)[sP].[dR](G)[sP].[dR](C)[sP].[LR](A)[sP].[dR](G)[sP].[LR](A)[sP].[dR](C)[sP].[dR](C)[sP].[dR](C)[sP].[LR](G)[sP].[LR](G)} | 1411 |
| SEQ ID 816 | GGTGAC AACTGG GCCTGC | GCAGGCCCAGTTG TCACC | SEQ ID 909 | [LR](G)[sP].[dR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[dR](T)[sP].[LR][G][sP].[LR]([5meC])} | 1412 |
| SEQ ID 817 | AACTGG GCCTGC ACCTGC | GCAGGTGCAGGCC CAGTT | SEQ ID 910 | [LR](A)[sP].[dR](A)[sP].[dR][C)[sP].[dR](T)[sP].[LR](G)[sP].[dR](G)[sP].[dR](G)[sP].[dR](C)[sP].[LR]([5meC])[sP].[dR](T)[sP].[dR][G)[sP].[dR][C)[sP].[LR](A)[sP].[dR](C)[sP].[dR](C)[sP].[dR](T)[sP].[LR](G)[sP].[LR]([5meC])} | 1413 |
| SEQ ID 818 | CTGCAC CTGCTG CAGAGG | CCTCTGCAGCAGG TGCAG | SEQ ID 911 | [LR]([5meC])[sP].[dR](T)[sP].[dR](G)[sP].[dR](C)[sP].[LR](A)[sP].[dR][C)[sP].[dR](C)[sP].[dR](T)[sP].[LR][G)[sP].[dR](C)[sP].[dR](T)[sP].[dR](G)[sP].[LR]([5meC])[sP].[dR](A)[sP].[dR](G)[sP].[dR](A)[sP].[LR](G)[sP].[LR](G)} | 1414 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 819 | CTGCTG CAGAGG TGCACG | CGTGCACCTCTGCA GCAG | SEQ ID 912 | [LR]([5meC])[sP].[dR](T)[sP].[LR](G)[sP].[dR](C)[sP].[dR](T)[sP].[LR](G)[sP].[dR](C)[sP].[dR](A)[sP].[dR](G)[sP].[LR](A)[sP].[dR](G)[sP].[dR](G)[sP].[dR](T)[sP].[LR](G)[sP].[dR][C][sP].[dR](A)[sP].[LR]([5meC])[sP].[LR](G)} | 1415 |
| SEQ ID 820 | TGCAGA GGTGCA CGTAGT | ACTACGTGCACCT CTGCA | SEQ ID 913 | [LR](T)[sP].[dR](G)[sP].[dR](C)[sP].[LR](A)[sP].[dR][G)[sP].[dR](A)[sP].[dR](G)[sP].[LR](G)[sP].[dR](T)[sP].[dR](G)[sP].[dR](C)[sP].[LR](A)[sP].[dR](C)[sP].[LR](G)[sP].[dR](T)[sP].[dR](A)[sP].[LR](G)[sP].[LR](T)} | 1416 |
| SEQ ID 821 | CAGAGG TGCACG TAGTCT | AGACTACGTGCAC CTCTG | SEQ ID 914 | [LR]([5meC])[sP].[dR](A)[sP].[dR](G)[sP].[LR](A)[sP].[dR](G)[sP].[dR](G)[sP].[dR](T)[sP].[LR](G)[sP].[dR](C)[sP].[LR][A][sP].[dR]([5meC])[sP].[dR](G)[sP].[dR](T)[sP].[LR](A)[sP].[dR](G)[sP].[dR](T)[sP].[LR]([5meC])[sP].[LR](T)} | 1417 |
| SEQ ID 822 | GGTGCA CGTAGT CTGAGT | ACTCAGACTACGT GCACC | SEQ ID 915 | [LR](G)[sP].[dR][G][sP].[dR](T)[sP].[LR](G)[sP].[dR](C)[sP].[dR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR](G)[sP].[dR](A)[sP].[LR](G)[sP].[LR](T)} | 1418 |
| SEQ ID 823 | TGCACG TAGTCT GAGTGC | GCACTCAGACTAC GTGCA | SEQ ID 916 | [LR](T)[sP].[dR](G)[sP].[dR](C)[sP].[LR](A)[sP].[dR](C)[sP].[LR](G)[sP].[dR](T)[sP].[dR](A)[sP].[dR](G)[sP].[LR](T)[sP].[dR](C)[sP].[dR](T)[sP].[LR](G)[sP].[dR](A)[sP].[dR](G)[sP].[dR](T)[sP].[LR](G)[sP].[LR]([5meC])} | 1419 |
| SEQ ID 824 | CGTAGT CTGAGT GCTGCG | CGCAGCACTCAGA CTACG | SEQ ID 917 | [LR]([5meC])[sP].[dR](G)[sP].[dR][T)[sP].[dR](A)[sP].[LR](G)[sP].[dR](T)[sP].[dR](C)[sP].[dR](T)[sP].[LR\|(G)[sP].[dR](A)[sP].[dR](G)[sP].[dR](T)[sP].[LR](G)[sP][dR](C)[sP].[dR](T)[sP].[dR](G)[sP].[LR]([5meC)[sP].[LR](G)} | 1420 |
| SEQ ID 825 | TAGTCT GAGTGC TGCGGA | TCCGCAGCACTCA GACTA | SEQ ID 918 | [LR](T)[sP].[dR](A)[sP].[dR](G)[sP].[LR](T)[sP].[dR][C][sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR](G)[sP].[LR](G)[sP].[LR](A)} | 1421 |
| SEQ ID 826 | CTGAGT GCTGCG GACTCA | TGAGTCCGCAGCA CTCAG | SEQ ID 919 | [LR]([5meC])[sP].[dR](T)[sP].[LR](G)[sP].[dR](A)[sP].[dR](G)[sP].[dR](T)[sP].[LR](G)[sP].[dR](C)[sP].[dR](T)[sP].[LR](G)[sP].[dR]([5meC])[sP].[dR][G][sP].[dR](G)[sP].[LR](A)[sP].[dR](C)[sP].[dR](T)[sP].[LR]([5meC])[sP].[LR](A)} | 1422 |
| SEQ ID 827 | GAGTGC TGCGGA CTCAGC | GCTGAGTCCGCAG CACTC | SEQ ID 920 | [LR](G)[sP].[dR](A)[sP].[dR](G)[sP].[dR](T)[sP].[LR](G)[sP].[dR](C)[sP].[dR](T)[sP].[LR][G)[sP].[dR]([5meC])[sP].[dR](G)[sP].[dR][G][sP].[LR](A)[sP].[dR](C)[sP].[LR](T)[sP].[dR][C][sP].[dR](A)[sP].[LR](G)[sP].[LR]([5meC])} | 1423 |
| SEQ ID 828 | GCTGCG GACTCA GCAGAC | GTCTGCTGAGTCC GCAGC | SEQ ID 921 | [LR](G)[sP].[dR](C)[sP].[dR](T)[sP].[LR](G)[sP].[dR]([5meC])[sP].[dR](G)[sP].[dR](G)[sP].[LR](A)[sP].[dR](C)[sP].[dR](T)[sP].[dR][C][sP].[LR](A)[sP].[dR](G)[sP].[dR](C)][sP].[LR](A)[sP].[dR](G)[sP].[LR](A)[sP].[LR]([5meC])} | 1424 |
| SEQ ID 829 | TGCGGA CTCAGC AGACCC | GGGTCTGCTGAGT CCGCA | SEQ ID 922 | [LR](T)[sP].[dR](G)[sP].[dR]([5meC])[sP].[dR](G)[sP].[LR](G)[sP].[dR](A)[sP].[dR](C)[sP].[dR](T)[sP].[LR]([5meC])[sP].[dR](A)[sP].[dR\|(G)[sP].[dR](C)[sP].[LR](A)[sP].[dR](G)[sP].[dR](A)[sP].[dR](C)[sP].[LR]([5meC])[sP].[LR]([5meC])} | 1425 |
| SEQ ID 830 | GACTCA GCAGAC CCGGCC | GGCCGGGTCTGCT GAGTC | SEQ ID 923 | [LR](G)[sP].[dR](A)[sP].[dR](C)[sP].[dR](T)[sP].[LR]([5meC])[sP].[dR](A)[sP].[dR](G)[sP].[dR](C)[sP].[LR](A)[sP].[dR](G)[sP].[dR](A)[sP].[dR](C)[sP][LR]([5meC])[sP].[dR]([5meC])[sP].[dR](G)[sP].[dR](G)[sP].[LR]([5meC])[sP].[LR]([5meC])} | 1426 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 831 | CTCAGCAGACCCGGCCAC | GTGGCCGGGTCTGCTGAG | SEQ ID 924 | [LR]([5meC])[sP].[dR](T)[sP].[dR](C)[sP].[dR](A)[sP].[LR](G)[sP].[dR][C)[sP].[dR](A)[sP].[dR](G)[sP].[LR](A)[sP].[dR][C)[sP].[dR](C)[sP].[dR](C)[sP].[LR](G)[sP].[dR](G)[sP].[dR](C)[sP].[dR][C)[sP].[LR][A][sP].[LR]([5meC])} | 1427 |
| SEQ ID 832 | CTGGTTATATAGCTCTTT | AAAGAGCTATATAACCAG | SEQ ID 925 | [LR]([5meC])[sP].[dR](T)[sP].[dR](G)[sP].[LR][G)[sP].[dR](T)[sP].[dR](T)[sP].[LR](A)[sP].[dR](T)[sP].[dR](A)[sP].[dR](T)[sP].[LR](A)[sP].[dR](G)[sP].[dR][C][sP].[dR](T)[sP].[LR]([5meC])[sP].[dR](T)[sP].[LR](T)[sP].[LR](T)} | 1428 |
| SEQ ID 833 | GGTTATATAGCTCTTTAA | TTAAAGAGCTATATATAACC | SEQ ID 926 | [LR](G)[sP].[dR](G)[sP].[dR](T)[sP].[dR](T)[sP].[LR](A)[sP].[dR](T)[sP].[LR](A)[sP].[dR](T)[sP].[LR](A)[sP].[dR](G)[sP].[dR](C)[sP].[dR](T)[sP].[LR]([5meC])[sP].[LR](T)[sP].[dR](T)[sP].[LR](T)[sP].[LR](A)[sP].[LR](A)} | 1429 |
| SEQ ID 834 | TTATATAGCTCTTTAATA | TATTAAAGAGCTATATAA | SEQ ID 927 | [LR](T)[sP].[LR](T)[sP].[dR](A)[sP].[dR](T)[sP].[LR](A)[sP].[LR](T)[sP].[dR](A)[sP].[dR](G)[sP].[LR]([5meC])[sP].[dR](T)[sP].[LR]([5meC])[sP].[dR](T)[sP].[LR](T)[sP].[LR](T)[sP].[dR](A)[sP].[dR](A)[sP].[LR](T)[sP].[LR](A)} | 1430 |
| SEQ ID 835 | ATATAGCTCTTTAATAAG | CTTATTAAAGAGCTATAT | SEQ ID 928 | [LR](A)[sP].[LR](T)\|sP].[dR](A)[sP].[LR](T)[sP].[dR](A)[sP].[dR](G)[sP].[LR]([5meC])[sP].[LR](T)[sP].[dR](C)[sP].[LR](T)[sP].[R](T)[sP].[dR](T)[sP].[LR](A)[sP].[LR](A)[sP].[dR](T)[sP].[LR](A)[sP].[LR](A)[sP].[LR](G)} | 1431 |
| SEQ ID 836 | ATAGCTCTTTAATAAGTC | GACTTATTAAAGAGCTAT | SEQ ID 929 | [LR](A)[sP].[dR](T)[sP].[dR](A)[sP].[LR](G)[sP].[dR](C)[sP].[LR](T)[sP].[LR]([5meC])[sP].[dR](T)[sP].[dR](T)[sP].[dR](T)[sP].[LR](A)[sP].[LR](A)[sP].[dR](T)[sP].[LR](A)[sP].[dR](A)[sP].[LR](G)[sP].[LR](T)[sP].[LR]([5meC])} | 1432 |
| SEQ ID 837 | AGCTCTTTAATAAGTCAG | CTGACTTATTAAAGAGCT | SEQ ID 930 | [LR](A)[sP].[dR](G)[sP].[LR]([5meC])[sP].[dR](T)[sP].[LR]([5meC])[sP].[dR](T)[sP].[dR](T)[sP].[dR](T)[sP].[LR](A)[sP].[dR](A)[sP].[dR](T)[sP].[LR](A)[sP].[LR](A)[sP].[dR](G)[sP].[LR](T)[sP].[dR](C)[sP].[LR](A)[sP].[LR](G)} | 1433 |
| SEQ ID 838 | CTCTTTAATAAGTCAGAA | TTCTGACTTATTAAAGAG | SEQ ID 931 | [LR]([5meC])[sP].[LR](T)[sP].[dR][C][sP].[LR](T)[sP].[LR](T)[sP].[dR](T)[sP].[dR](A)[sP].[LR](A)[sP].[dR](T)[sP].[LR](A)[sP].[LR](A)[sP].[dR](G)[sP].[dR][T)[sP].[LR]([5meC])[sP].[LR](A)[sP].[dR][G][sP].[LR](A)[sP].[LR][A)} | 1434 |
| SEQ ID 839 | CTTTAATAAGTCAGAATG | CATTCTGACTTATTAAAG | SEQ ID 932 | [LR]([5meC])[sP].[dR](T)[sP].[LR](T)[sP].[LR](T)[sP].[dR](A)[sP].[dR](A)[sP].[LR](T)[sP].[dR](A)[sP].[LR](A)[sP].[dR](G)[sP].[LR](T)[sP].[LR]([5meC])[sP].[dR](A)[sP].[LR](G)[sP].[dR](A)[sP].[LR](A)[sP].[LR](T)[sP].[LR](G)} | 1435 |
| SEQ ID 840 | TTAATAAGTCAGAATGAT | ATCATTCTGACTTATTAA | SEQ ID 933 | [LR](T)[sP].[LR](T)[sP].[dR](A)[sP].[LR](A)[sP].[LR](T)[sP].[dR](A)[sP].[LR](A)[sP].[dR](G)[sP].[LR](T)[sP].[dR][C][sP].[LR](A)[sP].[LR](G)[sP].[dR](A)[sP].[LR](A)[sP].[dR](T)[sP].[LR](G)[P].[LR](A)[sP].[LR](T)} | 1436 |
| SEQ ID 841 | AATAAGTCAGAATGATCC | GGATCATTCTGACTTATT | SEQ ID 934 | [LR](A)[sP].[LR](A)[sP].[dR](T)[sP].[dR](A)[sP].[dR](A)[sP].[LR](G)[sP].[dR](T)[sP].[LR]([5meC])[sP].[dR](A)[sP].[LR][G)[sP].[LR](A)[sP].[dR](A)[sP].[dR](T)[sP].[LR](G)[sP].[dR](A)[sP].[dR](T)[sP].[LR]([5meC])[sP].[LR]([5meC])} | 1437 |
| SEQ ID 842 | TAAGTCAGAATGATCCCT | AGGGATCATTCTGACTTA | SEQ ID 935 | [LR](T)[sP].[dR\|(A)[sP].[dR](A)[sP].[dR](G)[sP].[LR](T)[sP].[dR](C)[sP].[dR](A)[sP].[dR](G)[sP].[LR](A)[sP].[dR](A)[sP].[dR](T)[sP].[dR][G)[sP].[LR](A)[sP].[dR](T)[sP].[dR](C)[sP].[dR](C)[sP].[LR]([5meC])[sP].[LR](T)} | 1438 |

TABLE 12-continued

| Compound Table; compounds comprising modified nucleosides (SEQ ID NOs: 1011-1496). | | | | | |
|---|---|---|---|---|---|
| Motif SEQ ID | Motif Sequence | Target site sequence | Target SEQ | Compounds (HELM ANNOTATION) | SEQ ID NO. |
| SEQ ID 843 | AGTCAG AATGAT CCCTAC | GTAGGGATCATTCT GACT | SEQ ID 936 | [LR](A)[sP].[dR][G][sP].[dR](T)[sP].[dR][C][sP].[LR](A)[sP].[dR](G)[sP].[dR](A)[sP][LR](A)[sP].[dR](T)[sP].[LR](G)[sP].[dR](A)[sP].[dR](T)[sP].[dR](C)[sP].[LR]([5meC)[sP].[dR][C][sP].[dR](T)[sP].[LR][A][sP].[LR]([5meC])} | 1439 |
| SEQ ID 844 | TCAGAA TGATCC CTACCT | AGGTAGGGATCAT TCTGA | SEQ ID 937 | [LR](T)[sP].[dR](C)[sP].[dR](A)[sP].[dR](G)[sP].[LR](A)[sP].[dR](A)[sP].[dR](T)[sP].[LR](G)[sP].[dR](A)[sP].[dR](T)[sP].[dR](C)[sP].[LR]([5meC])[sP].[dR](C)[sP].[dR](T)[sP].[LR](A)[sP].[dR](C)[sP].[LR]([5meC])[sP].[LR](T)} | 1440 |
| SEQ ID 845 | AGAATG ATCCCT ACCTCT | AGAGGTAGGGATC ATTCT | SEQ ID 938 | [LR](A)[sP].[dR](G)[sP].[dR](A)[sP].[LR](A)[sP].[dR](T)[sP].[LR](G)\|sP].[dR](A)[sP].[dR](T)[sP].[dR](C)[sP].[LR]([5meC])[sP].[dR](C)[sP].[dR](T)[sP].[LR](A)[sP].[dR](C)[sP].[dR][C)[sP].[dR](T)[sP].[LR]([5meC])[sP].[LR](T)} | 1441 |
| SEQ ID 846 | AATGAT CCCTAC CTCTGA | TCAGAGGTAGGGA TCATT | SEQ ID 939 | [LR](A)[sP].[dR](A)[sP].[dR](T)[sP].[LR](G)[sP].[dR](A)[sP].[dR](T)[sP].[dR](C)[sP].[LR]([5meC])[sP].[dR](C)[sP].[dR](T)[sP].[LR](A)[sP].[dR](C)[sP].[dR](C)[sP].[LR](T)[sP].[dR](C)[sP].[dR](T)[sP].[LR](G)[sP].[LR](A)} | 1442 |
| SEQ ID 847 | ATCCCT ACCTCT GAATCT | AGATTCAGAGGTA GGGAT | SEQ ID 940 | [LR](A)[sP].[dR](T)[sP].[dR](C)[sP].[LR]([5meC])[sP].[dR](C)[sP].[dR](T)[sP].[LR](A)[sP].[dR](C)[sP].[dR][C][sP].[LR](T)[sP].[dR](C)[sP].[dR](T)[sP].[LR](G)[sP].[dR](A)[sP].[dR](A)[sP].[dR](T)[sP].[LR]([5meC])[sP].[LR](T)} | 1443 |
| SEQ ID 848 | CCCTAC CTCTGA ATCTGA | TCAGATTCAGAGGT AGGG | SEQ ID 941 | [LR]([5meC])[sP].[dR](C)[sP].[dR][C)[sP].[dR](T)[sP].[LR](A)[sP].[dR][C)[sP].[dR](C)[sP].[LR](T)[sP].[dR](C)[sP].[dR](T)[sP].[LR](G)[sP].[dR][A][sP].[LR](A)[sP].[dR](T)[sP].[dR][C)[sP].[dR](T)[sP].[LR](G)[sP].[LR](A)} | 1444 |
| SEQ ID 849 | CTACCT CTGAAT CTGAAG | CTTCAGATTCAGAG GTAG | SEQ ID 942 | [LR]([5meC][sP].[dR](T)[sP].[LR](A)[sP].[dR](C)[sP].[dR](C)[sP].[LR](T)[sP].[dR](C)[sP].[dR](T)[sP].[LR](G)[sP].[dR](A)[sP].[dR](A)[sP].[LR](T)[sP].[dR](C)[sP].[dR](T)[sP].[dR](G)[sP].[LR](A)[sP].[LR](A)[sP].[LR](G)} | 1445 |
| SEQ ID 850 | ACCTCT GAATCT GAAGAG | CTCTTCAGATTCAG AGGT | SEQ ID 943 | [LR](A)[sP].[dR](C)[sP].[dR](C)[sP].[dR](T)[sP].[LR]([5meC])[sP].[dR](T)[sP].[LR](G)[sP].[dR](A)[sP].[LR](A)[sP].[dR](T)[sP].[dR](C)[sP].[dR](T)[sP].[LR](G)[sP].[dR](A)[sP].[LR](A)[sP].[dR](G)[sP].[LR](A)[sP].[LR](G)} | 1446 |
| SEQ ID 851 | CTCTGA ATCTGA AGAGTC | GACTCTTCAGATTC AGGTAG | SEQ ID 944 | [LR]([5meC])[sP].[dR](T)[sP].[LR]([5meC])[sP].[dR](T)[sP].[dR](G)[sP].[dR](A)[sP].[LR](A)[sP].[dR](T)[sP].[dR](C)[sP].[LR](T)[sP].[dR](G)[sP].[dR](A)[sP].[dR](A)[sP].[LR](G)[sP].[dR](A)[sP].[dR](G)[sP].[LR](T)[sP].[LR]([5meC])} | 1447 |
| SEQ ID 852 | CTGAAT CTCAAG AGTCAA | TTGACTCTTCAGAT TCAG | SEQ ID 945 | [LR]([5meC])[sP].[dR](T)[sP].[LR](G)[sP].[dR][A)[sP].[dR](A)[sP].[LR](T)[sP].[dR](C)[sP].[LR](T)[sP].[LR](G)[sP].[dR](A)[sP].[LR](A)[sP].[LR](G)[sP].[dR](A)[sP].[dR](G)[sP].[LR](T)[sP].[dR](C)[sP].[LR](A)[sP].[LR](A)} | 1448 |
| SEQ ID 853 | ATCTGA AGAGTC AATACC | GGTATTGACTCTTC | SEQ ID 946 | [LR](A)[sP].[dR](T)[sP].[dR](C)[sP].[dR](T)[sP].[LR](G)[sP].[dR](A)[sP].[dR](A)[sP].[dR](G)[sP].[LR](A)[sP].[LR](G)[sP].[dR](T)[sP].[dR](C)[sP].[dR\|(A)[sP].[LR](A)[sP].[dR](T)[sP].[dR](A)[sP].[LR]([5meC])[sP].[LR]([5meC])} | 1449 |
| SEQ ID 854 | CTGAAG AGTCAA TACGCG | GCGGTATTGACTCT | SEQ ID 947 | [LR]([5meC])[sP].[dR](T)[sP].[LR\|(G)[sP].[dR](A)[sP].[dR](A)[sP].[dR](G)[sP].[LR](A)[sP].[dR](G)[sP].[dR](T)[sP].[dR](C)[sP].[LR](A)[sP].[dR](A)[sP].[dR](T)[sP].[LR](A)[sP].[dR][C][sP].[dR](C)[sP].[LR](G)[sP].[LR]([5meC])} | 1450 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 855 | GAAGAG TCAATA CCGCCA | TGGCGGTATTGAC TCTTC | SEQ ID 948 | [LR](G)[sP].[dR](A)[sP].[dR](A)[sP].[dR][G][sP].[LR](A)[sP].[dR](G)[sP].[dR](T) [sP].[dR](C)[sP].[LR](A)[sP].[dR](A)[sP].[dR](T)[sP].[LR](A)[sP].[dR](C)[sP].[dR] (C)[sP].[LR](G)[sP].[dR](C)[sP].[LR]([5meC])[sP].[LR](A)} | 1451 |
| SEQ ID 856 | AGAGTC AATACC GCCAGA | TCTGGCGGTATTGA CTCT | SEQ ID 949 | [LR](A)[sP].[dR](G)[sP].[dR](A)[sP].[dR][G][sP].[LR](T)[sP].[dR](C)[sP].[LR](A)[sP]. [dR](A)[sP].[dR](T)[sP].[LR](A)[sP].[dR](C)\|sP].[dR](C)[sP].[LR][G][sP].[dR](C) [sP].[dR](C)[sP].[dR](A)[sP].[LR](G)[sP].[LR](A)} | 1452 |
| SEQ ID 857 | AGTCAA TACCGC CAGAAT | ATTCTGGCGGTATT GACT | SEQ ID 950 | [LR](A)[sP].[dR](G)[sP].[dR](T)[sP].[dR](C)[sP].[LR](A)[sP].[dR](A)[sP].[dR](T)[sP]. [LR](A)[sP].[dR](C)[sP].[dR][C][sP].[LR](G)[sP].[dR][C][sP].[dR](C)[sP].[LR](A) [sP].[dR](G)[sP].[dR][A][sP].[LR](A)[sP].[LR](T)} | 1453 |
| SEQ ID 858 | TCAATA CCGCCA GAATCC | GGATTCTGGCGGT ATTGA | SEQ ID 951 | [LR](T)[sP].[dR](C)[sP].[LR](A)[sP].[dR][A][sP].[dR](T)[sP].[LR](A)[sP].[dR](C)[sP]. [dR](C)[sP].[LR](G)[sP].[dR](C)[sP].[dR](C)[sP].[dR](A)[sP].[LR](G)[sP].[dR](A) [sP].[LR](A)[sP].[dR](T)[sP].[LR](G)[sP].[LR](G)} | 1454 |
| SEQ ID 859 | TACCGC CAGAAT CCATGG | CCATGGATTCTGG CGGTA | SEQ ID 952 | [LR](T)[sP].[dR](A)[sP].[dR](C)[sP].[dR](C)[sP].[LR](G)[sP].[dR](C)[sP].[dR][C][sP]. [LR](A)[sP].[dR](G)[sP].[dR](A)[sP].[LR][A][sP].[dR](T)[sP].[dR][C][sP].[dR] (C)[sP].[LR](A)[sP].[dR](T)[sP].[LR](G)[sP].[LR](G)} | 1455 |
| SEQ ID 860 | CCGCCA GAATCC ATGGGG | CCCCATGGATTCTG GCGG | SEQ ID 953 | [LR]([5meC][sP].[dR]([5meC])[sP].[dR][G][sP].[dR][C][sP].[LR]([5meC])[sP].[dR] (A)[sP].[dR](G)[sP].[dR](A)[sP].[LR](A)[sP].[dR](T)[sP].[dR](C)[sP].[dR](C)[sP]. [LR](A)[sP].[dR](T)[sP].[dR](G)[sP].[dR](G)[sP].[LR](G)[sP].[LR](G)} | 1456 |
| SEQ ID 861 | CAGAAT CCATGG GGAGAT | ATCTCCCCATGGAT TCTG | SEQ ID 954 | [LR]([5meC])[sP].[dR][A][sP].[dR](G)[sP].[dR](A)[sP].[LR](A)[sP].[dR](T)[sP].[dR] (C)[sP].[dR](C)[sP].[LR](A)[sP].[dR](T)[sP].[dR](G)[sP].[dR](G)[sP].[LR](G)\|sP]. [dR](G)[sP].[dR](A)[sP].[dR](G)[sP].[LR](A)[sP].[LR](T)} | 1457 |
| SEQ ID 862 | GAATCC ATGGGG AGATGT | ACATCTCCCCATGG ATTC | SEQ ID 955 | [LR](G)[sP].[dR](A)[sP].[LR](A)[sP].[dR](T)[sP].[dR](C)[sP].[dR](C)[sP].\|[LR](A) [sP].[dR](T)[sP].[LR][G][sP].[dR](G)[sP].[dR](G)[sP].[dR][G][sP].[LR](A)[sP].[dR] (G)[sP].[dR](A)[sP].[dR](T)[sP].[LR](G)[sP].[LR](T)} | 1458 |
| SEQ ID 863 | ATCCAT GGGGAG ATGTTC | GAACATCTCCCCAT GGAT | SEQ ID 956 | [LR](A)[sP].[dR](T)[sP].[dR](C)[sP].[dR](C)[sP].[LR](A)[sP].[dR](T)[sP].[dR](G)[sP]. [dR](G)[sP].[LR](G)[sP].[dR](G)[sP].[dR](A)[sP].[dR](G)[sP].[LR](A)[sP].[dR] (T)[sP].[dR](G)[sP].[dR](T)[sP].[LR](T)[sP].[LR]([5meC])} | 1459 |
| SEQ ID 864 | ATGGGG AGATGT TCTGGA | TCCAGAACATCTCC CCAT | SEQ ID 957 | [LR](A)[sP].[dR](T)[sP].[dR](G)[sP].[dR](G)[sP].[LR](G)[sP].[dR](G)[sP].[dR](A) [sP].[dR](G)[sP].[LR](A)[sP].[dR](T)[sP].[dR\|(G)[sP].[dR](T)[sP].[LR](T)[sP].[R] (C)[sP].[dR](T)[sP].[dR](G)[sP].[LR](G)[sP].[LR](A)} | 1460 |
| SEQ ID 865 | GGGGAG ATGTTC TGGAGG | CCTCCAGAACATCT CCCC | SEQ ID 958 | [LR](G)[sP].[dR][G][sP].[dR](G)[sP].[dR][G][sP].[LR](A)[sP].[dR](G)[sP].[dR](A) [sP].[dR](T)[sP].[LR](G)[sP].[dR](T)[sP].[dR](T)[sP].[dR][C][sP].[LR](T)[sP].[dR] (G)[sP].[dR](G)[sP].[dR](A)[sP].[LR](G)[sP].[LR](G)} | 1461 |
| SEQ ID 866 | GGAGAT GTTCTG GAGGGG | CCCCTCCAGAACAT CTCC | SEQ ID 959 | [LR](G)[sP].[dR](G)[sP].[dR](A)[sP].[dR](G)[sP].[LR](A)[sP].[dR](T)[sP].[dR](G) [sP].[dR](T)[sP].[LR](T)[sP].[dR](C)[sP].[dR](T)[sP].[dR](G)[sP].[LR](G)[sP].[dR] (A)[sP].[dR](G)[sP].[dR](G)[sP].[LR](G)[sP].[LR](G)} | 1462 |

TABLE 12-continued

| Motif SEQ ID | Motif Sequence | Target site sequence | Target SEQ | Compounds (HELM ANNOTATION) | SEQ ID NO. |
|---|---|---|---|---|---|
| Compound Table; compounds comprising modified nucleosides (SEQ ID NOs: 1011-1496). | | | | | |
| SEQ ID 867 | AGATGT TCTGGA GGGGTG | CACCCCTCCAGAAC ATCT | SEQ ID 960 | [LR](A)[sP].[dR](G)[sP].[dR](A)[sP].[dR](T)[sP].[LR](G)[sP].[dR](T)[sP].[dR](T)[sP].[dR](C)[sP].[LR](T)[sP].[dR](G)[sP].[dR](G)[sP].[dR](A)[sP].[LR](G)[sP].[dR](G)[sP].[dR](G)[sP].[dR](G)[sP].[LR](T)[sP].[LR](G)} | 1463 |
| SEQ ID 868 | ATGTTC TGGAGG GGTGAC | GTCACCCCTCCAGA ACAT | SEQ ID 961 | [LR](A)[sP].[dR](T)[sP].[dR](G)[sP].[dR](T)[sP].[LR](T)[sP].[dR](C)[sP].[dR](T)[sP].[dR](G)[sP].[LR](G)[sP].[dR](A)[sP].[dR](G)[sP].[dR](G)[sP].[LR](G)[sP].[dR](G)[sP].[dR](T)[sP].[dR](G)[sP].[LR](A)[sP][LR]([5meC])} | 1464 |
| SEQ ID 869 | GTTCTG GAGGGG TGACAA | TTGTCACCCCTCCA GAAC | SEQ ID 962 | [LR](G)[sP].[dR](T)[sP].[LR](T)[sP].[dR][C][sP].[dR](T)[sP].[dR][G)[sP].[LR](G)[sP].[dR](A)[sP].[dR](G)[sP].[LR](G)[sP].[dR](G)[sP].[dR](G)[sP].[dR](T)[sP].[LR](G)[sP].[dR](A)[sP].[dR](C)[sP].[LR](A)[sP].[LR](A)} | 1465 |
| SEQ ID 870 | TCTGGA GGGGTG AVAACT | AGTTGTCACCCCTC CAGA | SEQ ID 963 | [LR](T)[sP].[dR](C)[sP].[dR](T)[sP].[dR](G)[sP].[LR](G)[sP].[dR](A)[sP].[dR](G)[sP].[LR][G)[sP].[dR](G)[sP].[dR][G)[sP].[dR](T)[sP].[LR](G)[sP].[dR](A)[sP].[dR](C)[sP].[LR](A)[sP].[dR](A)[sP].[LR]([5meC])[sP].[LR](T)} | 1466 |
| SEQ ID 871 | GAGGGG TGACAA CTGGGC | GCCCAGTTGTCAC CCCTC | SEQ ID 964 | [LR](G)[sP].[dR](A)[sP].[dR\| (G)[sP].[LR](G)[sP].[dR](G)[sP].[dR](G)[sP].[dR](T)[sP].[LR](G)[sP].[dR](A)[sP].[dR](C)[sP].[LR](A)[sP].[dR][A)[sP].[dR][C)[sP].[dR](T)[sP].[LR](G)[sP].[dR](G)[sP].[LR](G)[sP].[LR]([5meC])} | 1467 |
| SEQ ID 872 | GGGGTG ACAACT GGGCCT | AGGCCCAGTTGTCA CCCC | SEQ ID 965 | [LR](G)[sP].[dR](G)[sP].[dR](G)[sP].[LR](G)[sP].[dR](T)[sP].[LR](G)[sP].[dR](A)[sP].[dR](C)[sP].[LR](A)[sP].[dR](A)[sP].[dR](C)[sP].[dR](T)[sP].[LR](G)[sP].[dR](G)[sP].[dR](G)[sP].[dR](C)[sP].[LR]([5meC])[sP].[LR](T)} | 1468 |
| SEQ ID 873 | CAGCAG ACCCGG CCACTG | CAGTGGCCGGGTC TGCTG | SEQ ID 966 | [LR]([5meC])[sP].[dR](A)[sP].[dR](G)[sP].[dR][C][sP].[LR](A)[sP].[dR][G)[sP].[LR](A)[sP].[dR](C)[sP].[dR](C)[sP].[dR](C)[sP].[LR](G)[sP].[dR](G)[sP][dR](C)[sP].[dR](C)[sP].[LR](A)[sP].[dR](C)[sP].[LR](T)[sP].[LR](G)} | 1469 |
| SEQ ID 874 | GCAGAC CCGGCC ACTGGC | GCCAGTGGCCGGG TCTGC | SEQ ID 967 | [LR](G)[sP].[dR](C)[sP].[dR](A)[sP].[dR](G)[sP].[LR](A)[sP].[dR](C)[sP].[dR](C)[sP].[dR](C)[sP].[LR](G)[sP].[dR](G)[sP].[dR](C)[sP].[dR](C)[sP].[LR](A)[sP].[dR](C)[sP].[dR](T)[sP].[dR](G)[sP].[LR](G)[sP].[LR]([5meC])} | 1470 |
| SEQ ID 875 | AGACCC GGCCAC TGGCCT | AGGCCAGTGGCCG GGTCT | SEQ ID 968 | [LR](A)[sP].[dR](G)[sP].[LR](A)[sP].[dR](C)[sP].[dR](C)[sP].[dR](C)[sP].[LR](G)[sP].[dR](G)[sP].[dR](C)[sP].[dR](C)[sP].[LR](A)[sP].[dR](C)[sP].[dR](T)[sP].[LR](G)[sP].[dR](G)[sP].[dR](C)[sP].[LR]([5meC])[sP].[LR](T)} | 1471 |
| SEQ ID 876 | ACCCGG CCACTG GCCTCA | TGAGGCCAGTGGC CGGGT | SEQ ID 969 | [LR](A)[sP].[dR](C)[sP].[dR](C)[sP].[dR][C)[sP].[LR](G)[sP].[dR](G)[sP].[dR][C)[sP].[dR](C)[sP].[LR](A)[sP].[dR](C)[sP].[dR][T][sP].[dR](G)[sP].[LR][G)[sP].[dR](C)[sP].[dR](C)[sP].[dR](T)[sP].[LR]([5meC])[sP].[LR](A)} | 1472 |
| SEQ ID 877 | CCGGCC ACTGGC CTCACT | AGTGAGGCCAGTG GCCGG | SEQ ID 970 | [LR]([5meC])[sP].[dR](C)[sP].[LR](G)[sP].[dR](G)[sP].[dR](C)[sP].[dR](C)[sP].[LR](A)[sP].[dR](C)[sP].[dR](T)[sP].[LR](G)[sP].[dR][G][sP].[dR][C][sP].[dR](C)[sP].[LR](T)[sP].[dR](C)[sP].[dR](A)[sP].[LR]([5meC])[sP].[LR](T)} | 1473 |
| SEQ ID 878 | GGCCAC TGGCCT CACTTC | GAAGTGAGGCCAG TGGCC | SEQ ID 971 | [LR](G)[sP].[dR](G)[sP].[dR](C)[sP].[dR](C)[sP].[LR](A)[sP].[dR](C)[sP].[dR](T)[sP].[LR](G)[sP].[dR](G)[sP].[dR](C)[sP].[dR](C)[sP].[LR](T)[sP].[dR](C)[sP].[LR](A)[sP].[dR](C)[sP].[dR](T)[sP][LR](T)[sP].[LR]([5meC])} | 1474 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 879 | CCACTGGCCTCACTTCAT | ATGAAGTGAGGCCAGTGG | SEQ ID 972 | [LR]([5meC])[sP].[dR](C)[sP].[LR](A)[sP].[dR](C)[sP].[dR](T)[sP].[LR](G)[sP].[dR](G)[sP].[dR](C)[sP].[dR][C][sP].[LR](T)[sP].[dR](C)[sP].[dR](A)[sP].[dR](C)[sP].[LR](T)[sP].[dR](T)[sP].[dR](C)[sP].[LR](A)[sP].[LR](T)} | 1475 |
| SEQ ID 880 | ACTGGCCTCACTTCATTC | GAATGAAGTGAGGCCAGT | SEQ ID 973 | [LR](A)[sP].[dR](C)[sP].[dR](T)[sP].[LR](G)[sP].[dR](G)[sP].[dR](C)[sP].[dR](C)[sP].[LR](T)[sP].[dR](C)[sP].[LR](A)[sP].[dR](C)[sP].[dR](T)[sP].[LR](T)[sP].[dR](C)[sP].[dR][A)[sP].[dR](T)[sP].[LR](T)[sP].[LR]([5meC])] | 1476 |
| SEQ ID 881 | TGGCCTCACTTCATTCCC | GGGAATGAAGTGAGGCCA | SEQ ID 974 | [LR](T)[sP].[dR](G)[sP].[dR](G)[sP].[dR](C)[sP].[LR]([5meC])[sP].[dR](T)[sP].[dR](C)[sP].[LR](A)[sP].[dR](C)[sP].[dR](T)[sP].[LR](T)[sP].[dR](C)[sP].[LR](A)[sP].[dR](T)[sP].[dR](T)[sP].[dR](C)[sP].[LR]([5meC])[sP].[LR]([5MEc])} | 1477 |
| SEQ ID 882 | GCCTCACTTCATTCCCCT | AGGGGAATGAAGTGAGGC | SEQ ID 975 | [LR](G)[sP].[dR](C)[sP].[dR][C)[sP].[dR](T)[sP].[LR]([5meC])[sP].[dR](A)[sP].[dR](C)[sP].[dR](T)[sP].[LR\|(T)[sP].[dR](C)[sP].[dR](A)[sP].[dR}(T)[sP].[LR](T)[sP].[dR][C][sP].[dR](C)[sP].[dR](C)[sP].[LR]([5meC])[sP].[LR](T)} | 1478 |
| SEQ ID 883 | CTCACTTCATTCCCCTGG | CCAGGGGAATGAAGTGAG | SEQ ID 976 | [LR]([5meC])[sP].[dR](T)[sP].[dR](C)[sP].[LR](A)[sP].[dR][C][sP].[dR](T)[sP].[LR](T)[sP].[dR](C)[sP].[LR](A)[sP].[dR](T)[sP].[dR](T)[sP].[dR][C)[P].[LR]([5meC])[sP].[dR][C][sP].[dR](C)[sP].[dR](T)[sP].[LR](G)[sP].[LR](G)} | 1479 |
| SEQ ID 884 | CACTTCATTCCCCTGGGA | TCCCAGGGGAATGAAGTG | SEQ ID 977 | [LR]([5meC])[sP].[dR](A)[sP].[dR](C)[sP].[dR](T)[sP].[LR](T)[sP].[dR](C)[sP].[dR](A)[sP].[dR](T)[sP].[LR](T)[sP].[dR](C)[sP].[dR](C)[sP].[dR][C][sP].[LR]([5meC])[sP].[dR](T)[sP].[dR][G][sP].[dR][G)[sP].[LR](G)[sP].[LR](A)} | 1480 |
| SEQ ID 885 | CTTCATTCCCCTGGGAGG | CCTCCCAGGGGAATGAAG | SEQ ID 978 | [LR]([5meC])[sP].[dR](T)[sP].[dR](T)[sP].[dR](C)[P].[LR](A)[sP].[dR](T)[sP].[dR](T)[sP].[dR](C)[sP].[LR]([5meC])[sP].[dR](C)[sP].[dR](C)[sP].[dR](T)[sP].[LR](G)[sP].[dR](G)[sP].[dR](G)[sP].[dR](A)[sP].[LR](G)[sP].[LR](G)} | 1481 |
| SEQ ID 886 | TCATTCCCCTGGGAGGAA | TTCCTCCCAGGGGAATGA | SEQ ID 979 | [LR](T)[sP].[dR](C)[sP].[dR](A)[sP].[dR](T)[sP].[LR](T)[sP].[dR](C)[sP].[dR](C)[sP].[dR](C)[sP].[LR]([5meC])[sP].[dR](T)[sP].[dR](G)[sP].[dR](G)[sP].[LR](G)[sP].[dR](A)[sP].[dR](G)[sP].[dR][G)[sP].[LR](A)[sP].[LR](A)} | 1482 |
| SEQ ID 887 | ATTCCCCTGGGAGGAAAG | CTTTCCTCCCAGGGGAAT | SEQ ID 980 | [LR](A)[sP].[dR](T)[sP].[LR](T)[sP].[dR](C)[sP].[dB](C)[sP].[dR](C)[sP].[LR]([5meC])[sP].[dR](T)[sP].[dR](G)[sP].[dR](G)[sP].[LR](G)[sP].[dR](A)[sP].[dR](G)[sP].[dR](G)[sP].[LR](A)[sP].[dR](A)[sP].[LR](A)[sP].[LR](G)} | 1483 |
| SEQ ID 888 | TCCCCTGGGAGGAAAGAC | GTCTTTCCTCCCAGGGGA | SEQ ID 981 | [LR](T)[sP].[BR][C)[sP].[dR](C)[sP].[dR][C)[sP].[LR]([5meC])[sP].[dR](T)[sP].[dR](G)[sP].[dR](G)[sP].[LR](G)[sP].[dR](A)[sP].[dR](G)[sP].[dR](G)[sP].[LR](A)[sP].[dR](A)[sP].[dR](A)[sP].[dR](G)[sP].[LR](A)[sP].[LR]([5meC])] | 1484 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 889 | CCCTGG GAGGAA AGACCA | TGGTCTTTCCTCCC AGGG | SEQ ID 982 | [LR]([5meC])[sP].[dR](C)[sP].[dR](C)[sP].[dR](T)[sP].[LR](G)[sP].[dR](G)[sP].[LR](G)[sP].[dR](A)[sP].[dR](G)[sP].[dR][G][sP].[LR](A)[sP].[dR](A)[sP].[dR](A)[sP].[dR](G)[sP].[LR](A)[sP].[dR](C)[sP].[LR]([5meC])[sP].[LR](A)} | 1485 |
| SEQ ID 890 | CTGGGA GGAAAG ACCAAA | TTTGGTCTTTCCTC CCAG | SEQ ID 983 | [LR]([5meC])[sP].[dR](T)[sP].[dR](G)[sP].[dR][G][sP].[LR](G)[sP].[dR](A)[sP].[dR](G)[sP].[dR](G)[sP].[LR](A)[sP].[dR](A)[sP].[dR](A)[sP].[dR][G][sP].[LR](A)[sP].[LR]([5meC])[sP].[dR](C)[sP].[dR](A)[sP].[LR](A)[sP].[LR](A)} | 1486 |
| SEQ ID 891 | GGGAGG AAAGAC CAAAGT | ACTTTGGTCTTTCC TCCC | SEQ ID 984 | [LR](G)[sP].[dR](G)[sP].[LR](G)[sP].[dR](A)[sP].[dR](G)[sP].[dR](G)[sP].[LR](A)[sP].[dR](A)[sP].[dR](A)[sP].[dR](G)[sP].[LR](A)[sP].[dR](C)[sP].[dR][C][sP].[LR](A)[sP].[dR](A)[sP].[dR](A)[sP].[LR](G)[sP].[LR](T)} | 1487 |
| SEQ ID 892 | GAGGAA AGACCA AAGTGA | TCACTTTGGTCTTT CCTC | SEQ ID 985 | [LR](G)[sP].[dR](A)[sP].[LR](G)[sP].[dR](G)[sP].[dR](A)[sP].[dR][A][sP].[LR](A)[sP].[LR](G)[sP].[dR](A)[sP].[dR](C)[sP].[dR](C)[sP].[LR](A)[sP].[LR](A)[sP].[dR](A)[sP][dR](G)[sP].[dR](T)[sP].[LR](G)[sP].[LR](A)} | 1488 |
| SEQ ID 893 | GGAAAG ACCAAA GTGAAT | ATTCACTTTGGTCT TTCC | SEQ ID 986 | [LR](G)[sP].[dR](G)[sP].[dR](A)[sP].[dR](A)[sP].[LR](A)[sP].[LR](G)[sP].[dR](A)[sP].[LR]([5meC])[sP].[dR](C)[sP].[dR](A)[sP].[dR](A)[sP].[LR](A)[sP].[LR](G)[sP].[dR](T)[sP].[dR](G)[sP].[dR](A)[sP].[LR](A)[sP].[LR](T)} | 1489 |
| SEQ ID 894 | AAAGAC CAAAGT GAATAA | TTATTCACTTTGGT CTTT | SEQ ID 987 | [LR](A)[sP].[dR](A)[sP].[LR](A)[sP].[LR](G)[sP].[dR](A)[sP].[LR]([5meC)[sP].[LR]([5meC])[sP].[dR](A)[sP].[dR](A)[sP].[LR](A)[sP].[dR](G)[sP].[LR](T)[sP].[dR](G)[sP].[LR](A)[sP][dR](A)[sP].[LR](T)[sP].[LR](A)[sP].[LR](A)} | 1490 |
| SEQ ID 895 | AGACCA AAGTGA ATAAAC | GTTTATTCACTTTG GTCT | SEQ ID 988 | [LR](A)[sP].[LR](G)[sP][dR][A)[sP].[dR](C)[sP].[LR]([5meC])[sP].[LR](A)[sP].[dR](A)[sP].[LR](A)[sP].[dR][G][sP].[dR](T)[sP].[LR][G][sP].[LR](A)[sP].[dR](A)[sP].[LR](T)[sP].[dR](A)[sP].[LR](A)[sP].[LR](A)[sP].[LR]([5meC])} | 1491 |
| SEQ ID 896 | CAAAGT GAATAA ACAGCT | AGCTGTTTATTCAC | SEQ ID 989 | [LR]([5meC])[sP].[LR](A)[sP].[dR](A)[sP].[dR](A)[sP].[dR](G)[sP].[LR](T)[sP].[dR](G)[sP].[LR][A][sP].[dR](A)[sP].[dR](T)[sP].[LR](A)[sP].[dR](A)[sP].[LR](A)[sP].[R](C)[sP].[dR](A)[sP].[LR](G)[sP].[LR]([5meC])[sP].[LR](T)} | 1492 |
| SEQ ID 897 | AAGTGA ATAAAC AGCTTC | GAAGCTGTTTATTC | SEQ ID 990 | [LR](A)[sP].[LR](A)[sP].[dR](G)[sP].[dR](T)[sP].[LR][G][sP].[LR](A)[sP].[dR][A][sP].[LR](T)[sP].[LR](A)[sP].[dR](A)[sP].[dR](A)[sP].[dR](C)[sP].[LR](A)[sP].[dR](G)[sP].[LR]([5meC])[sP].[dR](T)[sP].[LR](T)[sP].[LR]([5meC]} | 1493 |
| SEQ ID 898 | GTGAAT AAACAG CTTCAA | TTGAAGCTGTTTAT | SEQ ID 991 | [LR](G)[sP].[LR](T)[sP].[dR](G)[sP].[LR](A)[sP].[dR](A)[sP].[LR](T)[sP].[LR](A)[sP].[dR](A)[sP].[LR](A)[sP].[LR]([5meC])[sP].[dR](A)[sP].[dR][G][sP].[dR][C][sP].[LR](T)[sP].[dR](T)[sP].[dR](C)[sP].[LR][A][sP].[LR](A)] | 1494 |
| SEQ ID 899 | GAATAA ACAGCT TCAAGT | ACTTGAAGCTGTTT | SEQ ID 992 | [LR](G)[sP].[dR](A)[sP].[dR](A)[sP].[LR](T)[sP].[LR](A)[sP].[dR](A)[sP].[LR](A)[sP].[LR]([5meC])[sP].[dR](A)[sP].[dR][G][sP].[dR][C][sP].[LR](T)[sP].[LR](T)[sP].[dR](C)[sP].[LR](A)[sP].[dR](A)[sP].[LR](G)[sP].[LR](T) | 1495 |

TABLE 12-continued

Compound Table; compounds comprising modified nucleosides (SEQ ID NOs: 1011-1496).

| Motif SEQ ID | Motif Sequence | Target site sequence | Target SEQ | Compounds (HELM ANNOTATION) | SEQ ID NO. |
|---|---|---|---|---|---|
| SEQ ID 900 | ATAAAC AGCTTC AAGTGC | GCACTTGAAGCTG TTTAT | SEQ ID 993 | [LR](A)[sP].[dR](T)[sP].[LR](A)[sP].[dR](A)[sP].[LR](A)[sP].[dR](C)[sP].[LR](A)[sP].[dR](G)[sP].[dR](C)[sP].[LR](T)[sP].[dR](T)[sP].[LR]([5meC])[sP].[dR][A)[sP].[LR](A)[sP].[dR](G)[sP].[dR](T)[sP].[LR](G)[sP].[LR]([5meC])\| | 1496 |

Helm Annotation Key:
[LR](G) is a beta-D-oxy-LNA guanine nucleoside,
[LR](T) is a beta-D-oxy-LNA thymine nucleoside,
[LR](A) is a beta-D-oxy-LNA adenine nucleoside,
[LR]([5meC] is a beta-D-oxy-LNA 5-methyl cytosine nucleoside,
[dR](G)is a DNA guanine nucleoside,
[dR](T)is a DNA thymine nucleoside,
[dR](A)is a DNA adenine nucleoside,
[dR][dR](C) is a DNA cytosine nucleoside,
[mR](G) is a 2'-O-methyl RNA guanine nucleoside,
[mR](U) is a 2'-O-methyl RNA uracil nucleoside,
[mR](A) is a 2'-O-methyl RNA adenine nucleoside,
[mR](C) is a 2'-O-methyl RNA cytosine nucleoside,
[sP] is a phosPhorothioate internucleoside linkage SEQUENCES
HAMSTER
SEQ ID 1: Hamster XBP1 gene
ATGGTGGTGGTGGCAGCGTCGCCGAGCGCGGCCACGGCGGCCCCGAAAGTACTGCTTCTATCGGGCCAGCCC

GCCGCGGACGGCCGGGCGCTGCCACTCATGGTTCCAGGCTCGCGGGCAGCAGGGTCCGAGGCGAACGGGGC

GCCACAGGCTCGCAAGCGGCAGCGCCTCACGCACCTGAGCCCGGAGGAGAAGGCGCTGCGGAGgtgggctcgg cgggcggggcggcaaggccgggcatgggaccctttctcgtgtggcggtcgggagggctctgtggggtggcgtagatgagcctctagtacctattt ctggagggaggcacggagctgaggtgacagcccctccgaaggtctgcttagtctgtgtcggggagtctaacacttgtcagacgggacctgacgc tcagccctctgtgaatgcttgctcttcttggaggacccatggcagggtccgctctggctgttgttgcagccgcttgggaacttaacactgggatccg agtcaccatcctccggcagcccgagttgagcttggggagggacggttggtagcgcccccgccgccttcacggagcctgttggacagaatcggaa ctagaaagccgcgggggaggagggaagatgcttatgacgcaacgggaatgtgtgtcagcccggtggtaaaataagactcgagtggacagcaa catgggagagaatcgagcaagtcttcaaggcccacgggcagaaaagctgtggtttttgtctttttgagaggaggagcctcagaatgtgtttacca ctgtttagtcttattctgtaaagtcagcgaaagcaccagctggccacatttacaaatgaagatacaggaaagctgaagatgactcggttcgttat gtgccctgtcttccttcagGAAACTGAAAAACAGAGTAGCAGCGCAGACTGCCCGAGATCGAAAGAAAGCCCGGAT GAGCGAGCTGGAACAGCAAGTGGTGGATTTGGAAGAAGAGgtaaagggatttaaggccatgctttcttctctgcccattcta agctgctgcagccctttagaatacaactaaagtgccatttaaagtttaactagcttagcagataggtggtgaaggcagacatgactcactcctga cagctagatactatcgatagaagttgctcagagattagccaggtcagatagatcctggcttaaccttcagtactcttgctcttgccaaaggctcac tagaattgccttccttctagggttctcttgttatctaatctgagcaagggctattgttttaaaagttttaatcatcagctggttcttagaagaaatgtg ggtcatatcagtagcagtttaaaaaaaatatttgttaggtatagcccaccattcccactttgtttttatactcagcatacagagtattaggacattt tcaaacagcgtgttttagttaattgattcttcctgccattttccctacaccccccagtatccttttaccttctcttggacttctagttgtttttttaaggcc ttacacacatttacatccattcatatgcattcacactctcacacacagtaaggtctacatatgcaagaaactcttggttctgtttgggccacctcactt aaaatatttaacaaatctacacatcttcctgccaacttctatttctttatagccgagtaacattcttctgtgcacatgtaccatattttcatctgtttc attggtgtctcccaattgctggtgttacaggcatgagccacccatgctagttttatgtagagctggaggctgaacccagggcttcatgtgtagtag ggcaagcactcttaccaactgatctacaccattagccaccagtgttgcaacagttatgaacgactgcatatgcacagaatttatcagttcaatga ggaaaccaactgtaacaaatcacgttttaatagcctcttctggattttcttacagAACCAAAAACTTCTGTTAGAAAATCAGCTTTT

GAGAGAGAAAACTCATGGCCTTGTAATTGAGAACCAGGAGTTAAGAACTCGCTTGGGAATGGATGTGCTGAC

TACTGAAGAGGCTCCAGAGACGGAGTCCAAGgtaaatcttatgagacttggttgtgacatgaacggattgtatttgtgatcccaac ctctatcaagccttccttttctcttttccttcttttgagacagggtcttaatttcttaattttggatggtcttgaaattgtatcagttttatggcctctg cctccaaagtaatggaactagacatgtgccaccatgcctagctgatcagtcttgaaaatttctccacatttccaacagacctgttcagtcttcagtgac tcattcttcaagtgtgtaatgaagtgttactaagccctaataatcctaataatttacatagctctctcagaataagtgctaacaccagtagccagca agctataccatgcaggcatcaaatagaatgagactgtaagggctagtcagatttgggagattttgatcttgttttgagacagagtctctgtatata attaacccaggttggctttggactcatcctctggccatagcctcccaggtgctgggattttaggcactacaattggcttgtttcctggacttttgaca gccctcatgtggcctaggttggtcttaaacttgatatgttagctgataattctgtctctgctttccaagtgttaagatacgggcacatactactttatc tggcggagttatgtaggcatggtgtttgtgtacatgagtatcttactaaatctggagctaggctggtggctagcaaatcctggtgatcctcttgtctc tgtctccctcagtgttggggttatacaggcacaactgtcatgctccaaattttacattgatgcttgcctaacaagcaggcttatgctctgagccacct cccatagcctggtgtgcatttccttggagtgttccctcactttggtctttccttccagGGAAATGGAGTAAGGCCGGTGGCCGGGTCT GCTGAGTCCGCAGcactcagactacgtgcacctctgcagCAGGTGCAGGCCCAGTTGTCACCTCCCCAGAACATCTTCC CATGGATTCTGACACTGTTGACTCTTCAGACTCCGAGgtagagcttgtttgccttactaaagcactgtgtaagattggctcattct gtagtatatatatgatgtgtgacatgcctagccaggcaaatggagaaagaagttagtattggtagggttaggggtaagcagtcactttcttaattt ccagtggtttaggtcatggagtcgggagaagctgttctgatgggtgtgtccttcgatctgacagcataaggcctaactgacattgtggaactcagt actaagtgtttctggtagaccatcacattctaatagtgaactttttttgtcttacctcttgcagTCTGATATCCTTTTGGGCATTCTGGAC

AAGTTGGACCCTGTCATGTTTTTCAAATGTCCATCCCCAGAGTCTGCCAATCTGGAGGAACTCCCAGAGGTCTA

-continued

CCCAGGACCTAGTTCCTTACCAGCCTCCCTTTCTCTGTCAGTGGGGACCTCATCAGCCAAGCTGGAAGCCATTA

ATGAACTCATTCGCTTTGACCATGTATACACCAAGCCTCTAGTCTTAGAGATCCCTTCTGAGACAGAGAGTCAA

ACTAATGTGGTAGTGAAAATTGAGGAAGCACCTCTCAGCTCTTCAGAGGAGGATCACCCTGAATTCATTGTCT

CAGTGAAGAAAGAACCTTTGGAAGAAGACTTCATTCCAGAGCCGGGCATCTCAAACCTGCTTTCATCCAGCCA

CTGTCTGAAACCATCTTCCTGCCTGCTGGATGCTTATAGTGACTGTGGATATGAGGGCTCCCCTTCTCCCTTCA

GTGACATGTCTTCTCCACTTGGTATAGACCATTCTTGGGAGGACACTTTTGCCAATGAACTCTTTCCCCAGCTA

ATTAGTGTCTAA

SEQ ID 2: Hamster Xbp1-202 (Xbp-1u)
ATGGTGGTGGTGGCAGCGGCGCCGAGCGCGGCCACGGCGGCCCCGAAAGTACTGCTTCTATCGGGCCAGC

CCGCCGCGGACGGCCGGGCGCTGCCACTCATGGTTCCAGGCTCGCGGGCAGCAGGGTCCGAGGCGAACGG

GGCGCCACAGGCTCGCAAGCGGCAGCGCCTCACGCACCTGAGCCCGGAGGAGAAGGCGCTGCGGAGGAAA

CTGAAAAACAGAGTAGCAGCGCAGACTGCCCGAGATCGAAAGAAAGCCCGGATGAGCGAGCTGGAACAGC

AAGTGGTGGATTTGGAAGAAGAGAACCAAAAACTTCTGTTAGAAAATCAGCTTTTGAGAGAGAAAACTCA

TGGCCTTGTAATTGAGAACCAGGAGTTAAGAACTCGCTTGGGAATGGATGTGCTGACTACTGAAGAGGCT

CCAGAGACGGAGTCCAAGGGAAATGGAGTAAGGCCGGTGGCCGGGTCTGCTGAGTCCGCAGCACTCAGAC

TACGTGCACCTCTGCAGCAGGTGCAGGCCCAGTTGTCACCTCCCCAGAACATCTTCCCATGGATTCTGAC

ACTGTTGACTCTTCAGACTCCGAGTCTGATATCCTTTTGGGCATTCTGGACAAGTTGGACCCTGTCATGT

TTTTCAAATGTCCATCCCCAGAGTCTGCCAATCTGGAGGAACTCCCAGAGGTCTACCCAGGACCTAGTTC

CTTACCAGCCTCCCTTTCTCTGTCAGTGGGGACCTCATCAGCCAAGCTGGAAGCCATTAATGAACTCATT

CGCTTTGACCATGTATACACCAAGCCTCTAGTCTTAGAGATCCCTTCTGAGACAGAGAGTCAAACTAATG

TGGTAGTGAAAATTGAGGAAGCACCTCTCAGCTCTTCAGAGGAGGATCACCCTGAATTCATTGTCTCAGT

GAAGAAAGAACCTTTGGAAGAAGACTTCATTCCAGAGCCGGGCATCTCAAACCTGCTTTCATCCAGCCAC

TGTCTGAAACCATCTTCCTGCCTGCTGGATGCTTATAGTGACTGTGGATATGAGGGCTCCCCTTCTCCCT

TCAGTGACATGTCTTCTCCACTTGGTATAGACCATTCTTGGGAGGACACTTTTGCCAATGAACTCTTTCC

CCAGCTAATTAGTGTCTAA

SEQ ID 3: Hamster predicted protein from SEQ ID 2
MVVVAAAPSAATAAPKVLLLSGQPAADGRALPLMVPGSRAAGSEANGAPQARKRQRLTHLSPEEKALRRKLKNR

VAAQTARDRKKARMSELEQQVVDLEEENQKLLLENQLLREKTHGLVIENQELRTRLGMDVLTTEEAPETESKGNG

VRPVAGSAESAALRLRAPLQQVQAQLSPPQNIFPWILTLLTLQTPSLISFWAFWTSWTLSCFSNVHPQSLPIWRNS

QRSTQDLVPYQPPFLCQWGPHQPSWKPLMNSFALTMYTPSL

SEQ ID 4: Hamster Xbp1-201 (Xbp-1s)
ATGGTGGTGGTGGCAGCGTCGCCGAGCGCGGCCACGGCGGCCCCGAAAGTACTGCTTCTATCGGGCCAGC

CCGCCGCGGACGGCCGGGCGCTGCCACTCATGGTTCCAGGCTCGCGGGCAGCAGGGTCCGAGGCGAACGG

GGCGCCACAGGCTCGCAAGCGGCAGCGCCTCACGCACCTGAGCCCGGAGGAGAAGGCGCTGCGGAGGAAA

CTGAAAAACAGAGTAGCAGCGCAGACTGCCCGAGATCGAAAGAAAGCCCGGATGAGCGAGCTGGAACAGC

AAGTGGTGGATTTGGAAGAAGAGAACCAAAAACTTCTGTTAGAAAATCAGCTTTTGAGAGAGAAAACTCA

TGGCCTTGTAATTGAGAACCAGGAGTTAAGAACTCGCTTGGGAATGGATGTGCTGACTACTGAAGAGGCT

CCAGAGACGGAGTCCAAGGGAAATGGAGTAAGGCCGGTGGCCGGGTCTGCTGAGTCCGCAGCAGGTGCAG

GCCCAGTTGTCACCTCCCCAGAACATCTTCCCATGGATTCTGACACTGTTGACTCTTCAGACTCCGAGTC

TGATATCCTTTTGGGCATTCTGGACAAGTTGGACCCTGTCATGTTTTTCAAATGTCCATCCCCAGAGTCT

GCCAATCTGGAGGAACTCCCAGAGGTCTACCCAGGACCTAGTTCCTTACCAGCCTCCCTTTCTCTGTCAG

TGGGGACCTCATCAGCCAAGCTGGAAGCCATTAATGAACTCATTCGCTTTGACCATGTATACACCAAGCC

-continued

TCTAGTCTTAGAGATCCCTTCTGAGACAGAGAGTCAAACTAATGTGGTAGTGAAAATTGAGGAAGCACCT

CTCAGCTCTTCAGAGGAGGATCACCCTGAATTCATTGTCTCAGTGAAGAAAGAACCTTTGGAAGAAGACT

TCATTCCAGAGCCGGGCATCTCAAACCTGCTTTCATCCAGCCACTGTCTGAAACCATCTTCCTGCCTGCT

GGATGCTTATAGTGACTGTGGATATGAGGGCTCCCCTTCTCCCTTCAGTGACATGTCTTCTCCACTTGGT

ATAGACCATTCTTGGGAGGACACTTTTGCCAATGAACTCTTTCCCCAGCTGATTAGTGTCTAA

SEQ ID 5: Hamster predicted protein from SEQ ID 4
MVVVAASPSAATAAPKVLLLSGQPAADGRALPLMVPGSRAAGSEANGAPQARKRQRLTHLSPEEKALRRKLKNR

VAAQTARDRKKARMSELEQQVVDLEEENQKLLLENQLLREKTHGLVIENQELRTRLGMDVLTTEEAPETESKGNG

VRPVAGSAESAAGAGPVVTSPEHLPMDSDTVDSSDSESDILLGILDKLDPVMFFKCPSPESANLEELPEVYPGPSSLP

ASLSLSVGTSSAKLEAINELIRFDHVYTKPLVLEIPSETESQTNVVVKIEEAPLSSSEEDHPEFIVSVKKEPLEEDFIPEPGI

SNLLSSSHCLKPSSCLLDAYSDCGYEGSPSPFSDMSSPLGIDHSWEDTFANELFPQLISV

SEQ ID 6: Hamster XBP1?4
ATGGTGGTGGTGGCAGCGGCGCCGAGCGCGGCCACGGCGGCCCCGAAAGTACTGCTTCTATCGGGCCAGC

CCGCCGCGGACGGCCGGGCGCTGCCACTCATGGTTCCAGGCTCGCGGGCAGCAGGGTCCGAGGCGAACGG

GGCGCCACAGGCTCGCAAGCGGCAGCGCCTCACGCACCTGAGCCCGGAGGAGAAGGCGCTGCGGAGGAAA

CTGAAAAACAGAGTAGCAGCGCAGACTGCCCGAGATCGAAAGAAAGCCCGGATGAGCGAGCTGGAACAGC

AAGTGGTGGATTTGGAAGAAGAGAACCAAAAACTTCTGTTAGAAAATCAGCTTTTGAGAGAGAAAACTCA

TGGCCTTGTAATTGAGAACCAGGAGTTAAGAACTCGCTTGGGAATGGATGTGCTGACTACTGAAGAGGCT

CCAGAGACGGAGTCCAAGTCTGATATCCTTTTGGGCATTCTGGACAAGTTGGACCCTGTCATGT

TTTTCAAATGTCCATCCCCAGAGTCTGCCAATCTGGAGGAACTCCCAGAGGTCTACCCAGGACCTAGTTC

CTTACCAGCCTCCCTTTCTCTGTCAGTGGGGACCTCATCAGCCAAGCTGGAAGCCATTAATGAACTCATT

CGCTTTGACCATGTATACACCAAGCCTCTAGTCTTAGAGATCCCTTCTGAGACAGAGAGTCAAACTAATG

TGGTAGTGAAAATTGAGGAAGCACCTCTCAGCTCTTCAGAGGAGGATCACCCTGAATTCATTGTCTCAGT

GAAGAAAGAACCTTTGGAAGAAGACTTCATTCCAGAGCCGGGCATCTCAAACCTGCTTTCATCCAGCCAC

TGTCTGAAACCATCTTCCTGCCTGCTGGATGCTTATAGTGACTGTGGATATGAGGGCTCCCCTTCTCCCT

TCAGTGACATGTCTTCTCCACTTGGTATAGACCATTCTTGGGAGGACACTTTTGCCAATGAACTCTTTCC

CCAGCTAATTAGTGTCTAA

SEQ ID 7: Hamster predicted protein from SEQ ID 6
MVVVAAAPSAATAAPKVLLLSGQPAADGRALPLMVPGSRAAGSEANGAPQARKRQRLTHLSPEEKALRRKLKNR

VAAQTARDRKKARMSELEQQVVDLEEENQKLLLENQLLREKTHGLVIENQELRTRLGMDVLTTEEAPETESKSDILL

GILDKLDPVMFFKCPSPESANLEELPEVYPGPSSLPASLSLSVGTSSAKLEAINELIRFDHVYTKPLVLEIPSETESQTNV

VVKIEEAPLSSSEEDHPEFIVSVKKEPLEEDFIPEPGISNLLSSSHCLKPSSCLLDAYSDCGYEGSPSPFSDMSSPLGIDHS

WEDTFANELFPQLISV

MOUSE
SEQ ID 590: Mouse XBP1 gene
CTAGGGTAAAACCGTGAGACTCGGTCTGGAAATCTGGCCTGAGAGGACAGCCTGGCAATCCTCAGCCGGGGT

GGGGACGTCTGCCGAAGATCCTTGGACTCCAGCAACCAGTGGTCGCCACCGTCCATCCACCCTAAGGCCCAGT

TTGCACGGCGGAGAACAGCTGTGCAGCCACGCTGGACACTCACCCCGCCCGAGTTGAGCCCGCCCCCGGGAC

TACAGGACCAATAAGTGATGAATATACCCGCGCGTCACGGAGCACCGGCCAATCGCGGACGGCCACGACCCT

AGAAAGGCTGGGGGGGGCAGGAGGCCACGGGGCGGTGGGGGCGCTGGCGTAGACGTTTCCTGGCTATGGT

GGTGGTGGCAGCGGCGCCGAGCGCGGCCACGGCGGCCCCCAAAGTGCTACTCTTATCTGGCCAGCCCGCCTC

CGGCGGCCGGGCGCTGCCGCTCATGGTACCCGGTCCGCGGGCAGCAGGGTCGGAGGCGAGCGGGACACCG

CAGGCTCGCAAGCGGCAGCGGCTCACGCACCTGAGCCCGGAGGAGAAAGCGCTGCGGAGGTGGGCCCGGC

-continued

GGGCAAGGCTGGGGCGCGGGGCGGCAGGACTGGGATTGGGACTCTCTCGTGTGTGCCAGCTGGTGGGCTCC

GTACGGTGGGTTAGATTCACCTCTAGTGTCTAACCTGGGAAGCGGAGCTGAGGGGGATGCCCCTCCGAAGGT

CTGCGTCGGGGGTGTGTGCAGGAGCTCCCGACACAGGCACAGAAGAAGGTGCCCGACGCCCAGTCCTCTGTA

AATGCTCGCTCTTTGTGGTCGTAGGGTAGGAACCGCTCCAGCTGTCATTGCAGCCACTTGGGAACCCCACCCT

GGGAACCGAGTCCACAGCGTCCGGCATCCCGAGAGTTTGGCTTGGGGAGGGACAGTTGGTAGCGTCCCCGCC

GCCTTCACGGATATCGCTCTAGCAAGGAGCCTGTGGGACGGAATTGGACCCAGAAAGTAGCGGGGGAGGAG

GGAAGAAGCATATGACGCAACGGGAATGTATCAGCCCGGTGGTAAAATGAGATCCGGGTGGACAGCCGCAC

GGGAGAGAATCAAGCAAGTCTTCAAGGCCTGTGGATAGAAAGCAGCGTGTGTATGCGTGTGCGTGTGCGTTT

TGATAGGAGCTTTAAGCGTGTTTACTTGCTAAGCCTTATTCTGTAAAGTCAACGAAAGCACCAGCTGGCCACG

TCTACAAATGAAGACACATGAAAGCTGGAGATGACTCAGTTATGTTCCCTGTCTCCTCCCCAAGGAAACTGAA

AAACAGAGTAGCAGCGCAGACTGCTCGAGATAGAAAGAAAGCCCGGATGAGCGAGCTGGAGCAGCAAGTG

GTGGATTTGGAAGAAGAGGTAAAGGGACTTCAGGCCATGCTTTCATCCCATCCATATCAGGGCCCATCCTAAA

CTGCTTCAGCCCTTTAGAATACAACCCAAAGTGCCATTTAAAGTTTAACCAGCCTAGCAGATAGGCCGTGAAA

GCAGACGTGACTCACCCTGGCCTGCCCTCCCCTCGGAGATTAGCCAGGTTGGATAGATCATTGGTTGCTTAAG

CTGTAGCGCCGCCTGTCTTTGCCAAAGGCTCACTAACGCTGCCCTTCCTTCTGGGATCCCCCCCCCCCCGCGCG

CCCCCAATCCTCCCACCCTCTGTATCCTTTCTGCTGTCAGTGCCCTTTTGTGCCCCTCCACCCCGGCATCCTTTTA

CCCTTTGGGGAGTTATTTAGTTTCTAAGTTAAGTTTAGTTAACTTTAGCTATTTCTAGCGTTTCTAGGCATTGC

CACATTTACGTCCATTTATATGCGCACGTGCGCCCTGGTTTGAGTTTGGGTCACCTCACTTTGTAATACACTTTC

CAAATTTATACATTTTCCCTGCTAGTTTCCTTTCTCTATACAGGCGAGTGGTACCTCACTGTGTGTGCACCCCAC

TTTCACGGTTCTCTGGGCATCTGTGCTCAGCATCTAGGCTGCCACCATTTCTTTGCCATTGGACCACTACCACTT

GCACCAACACTTGCCATTTCAAGACAGGATGGTGAATTATTTAAAGATTATTTTTAGATAGGGTCTTAGGTTGG

CCTGTAACTCATGGCATGCCTCCTGTTTTACCATGCTGACATTACAGGCAGTGAACCACCTTGCCATACTTTTTT

TTTTTAAAGGTAGTGTATTAACACAACTGTAAATTCAAGCTGCAAGTGACCTTTTTTTTTGGCTGAAATCTGCG

AGTAGTACTTGTAGGCATTATGTTGTTTCTGTCACCATTGAAAACACTTTTGTTTTCTTCAGAGATTGGCCTTGA

ATAAACTTGCTTCTCCCGCCTCAGCCTGCTTGAGTGTTCAATGGCATTTTTGGGGGGACAGCTTGATGTCTCCC

AGGCTGTGCTCTAACTTGCTGTGTAGCCAAAGATGACCCCAAATTTGTTTCTCTTGCTGCTATGTCCCAGGTGC

TGGGATTACAGTTTATGCAGAGCTGAAGATGGAGCCCAGGGCTGCAAGCCTGGGAGGGCAGGCCTTCTCCCA

ACTCCTCTGTCCCATTAGCCACCGGTGACAGAATGGCTGTGACCCGCACCAGCAGGGAAACAGCTGGAGCAG

AACTTGCAGTGGATTCTTTAGTGACGGAACCACACGGTCTAACCGCACGGCCTCTTATGTGATTCCTTACAGAA

CCACAAACTCCAGCTAGAAAATCAGCTTTTACGGGAGAAAACTCACGGCCTTGTGGTTGAGAACCAGGAGTTA

AGAACACGCTTGGGAATGGACACGCTGGATCCTGACGAGGTTCCAGAGGTGGAGGCCAAGGTAAGTATTGG

GAGACCTGGCTGCAGCACTACCTGGCTGCAGGTTTGTGTTCTGGACCTCCAATCAAATCCTTTTCTCTTTTCCTT

TATGAGACAAGGTCTTAATGTCTAATTTTGGCTGGTCTTGAACTTGTGTCAGTTCTTTTGCTTCTAAGTAGTAG

GACTATAAGCACCTGCCCCTGTGCCTAGCTGAGGAATCCTGAATTTTCCCTGTTTCCTTGAACTAAACTTATGAT

CTTCTTGCCTTAGCCTTCCAAGCGCTGGAATTACATGCATGAACAAGTGGTTTGTTTCTTGGCTTTTTTGGGGG

ATAGGGTGTCATGTAGTCCAGGTTGGCCTCAAACTTGCTCTGTAGCTGATAATCCTACCTCCACCTTCCAGATG

TTACCATTACAGGCAGATGTTCCTTTGTGTGGTTATGTAGGTGTGTATGTGTACATGGGTGTGGGTTTATACAC

ATCTCTGCTTACGTACAGAGGCCTAAGGAGCATATAGATGTCTTGCCCTAGCACTGTCCACCCTGCTCCTCTGC

AGCAGAGTGTCTCACTGAATCTGGGGCTAGGCAGGTGGACAGCAAGCCCTGGTGAACTTCCTGTTTCTGCCTC

CCTTGATGCTGAGGATTTGAACTTGGGTCTTCAGGATTGTACAGCAAGCACATTATATTCAGAGCCACCTCCCC

AGTTCCTTTCGAGCCCTTTGAGGAGCAGAGACTCACAGCTACCCAGCATGTATATCCTTGGCAACTTTTACTCA

-continued

CTGTGGTCTTTCCTTCCAGGGGAGTGGAGTAAGGCTGGTGGCCGGGTCTGCTGAGTCCGCAGCACTCAGACT

ATGTGCACCTCTGCAGCAGGTGCAGGCCCAGTTGTCACCTCCCCAGAACATCTTCCCATGGACTCTGACACTGT

TGCCTCTTCAGATTCTGAGGTAGAGCTTATTCTGTAGCCTAAGTGGCGTGTGACACGCTTAGCCAGGCAAACG

GAGAAGTTAGTATTGGTGGGGTTAGGATTAAGCACTTTCCTAGTCTGCTTAAGTGGATGGAGTAGGGGGAAA

CTGTTCCGTGGGTGGGTCCTATGATCTGAGAGCATAAGTCTGGTGGATGGCTGGGTCCTGTGATCTGAGAGT

GTAAGCCCTAAGTAACATTGTGGAACCCAGTACTAAAAGTATTTCTGGTAGACTGTCACATTCATTCTAATAGT

GAACTCTTTTGTGTTTTGCCTCTTGTAGTCTGATATCCTTTTGGGCATTCTGGACAAGTTGGACCCTGTCATGTT

TTTCAAATGTCCTTCCCCAGAGTCTGCTAGTCTGGAGGAACTCCCAGAGGTCTACCCAGAAGGACCTAGTTCCT

TACCAGCCTCCCTTTCTCTGTCAGTGGGGACCTCATCAGCCAAGCTGGAAGCCATTAATGAACTCATTCGTTTT

GACCATGTATACACCAAGCCTCTAGTTTTAGAGATCCCCTCTGAGACAGAGAGTCAAACTAACGTGGTAGTGA

AAATTGAGGAAGCACCTCTAAGCTCTTCAGAAGAGGATCACCCTGAATTCATTGTCTCAGTGAAGAAAGAGCC

TTTGGAAGATGACTTCATCCCAGAGCTGGGCATCTCAAACCTGCTTTCATCCAGCCATTGTCTGAGACCACCTT

CTTGCCTGCTGGACGCTCACAGTGACTGTGGATATGAGGGCTCCCCTTCTCCCTTCAGTGACATGTCTTCTCCA

CTTGGTACAGACCACTCCTGGGAGGATACTTTTGCCAATGAACTTTTCCCCCAGCTGATTAGTGTCTAAAGAGC

CACATAACACTGGGCCCCTTTCCCTGACCATCACATTGCCTAGAGGATAGCATAGGCCTGTCTCTTTCGTTAAA

AGCCAAAGTAGAGGCTGTCTGGCCTTAGAAGAATTCCTCTAAAGTATTTCAAATCTCATAGATGACTTCCAAGT

ATTGTCGTTTGACACTCAGCTGTCTAAGGTATTCAAAGGTATTCCAGTACTACAGCTTTTGAGATTCTAGTTTAT

CTTAAAGGTGGTAGTATACTCTAAATCGCAGGGAGGGTCATTTGACAGTTTTTTCCCAGCCTGGCTTCAAACTA

TGTAGCCGAGGCTAGGCAGAAACTTCTGACCCTCTTGACCCCACCTCCCAAGTGCTGGGCTTCACCAGGTGTG

CACCTCCACACCTGCCCCCCCGACATGTCAGGTGGACATGGGATTCATGAATGGCCCTTAGCATTTCTTTCTCC

ACTCTCTGCTTCCCAGGTTTCGTAACCTGAGGGGGCTTGTTTTCCCTTATGTGCATTTTAAATGAAGATCAAGA

ATCTTTGTAAAATGATGAAAATTTACTATGTAAATGCTTGATGGATCTTCTTGCTAGTGTAGCTTCTAGAAGGT

GCTTTCTCCATTTATTTAAAACTACCCTTGCAATTAAAAAAAAAGCAACACAGCGTCCTGTTCTGTGATTTCTAG

GGCTGTTGTAATTTCTCTTTATTGTTGGCTAAAGGAGTAATTTATCCAACTAAAGTGAGCATACCACTTTTTAAA

GTCA

SEQ ID 591: Mouse Xbp1, transcript variant 1, (mRNA not IRE1 processed)
CTAGGGTAAAACCGTGAGACTCGGTCTGGAAATCTGGCCTGAGAGGACAGCCTGGCAATCCTCAGCCGGGGT

GGGGACGTCTGCCGAAGATCCTTGGACTCCAGCAACCAGTGGTCGCCACCGTCCATCCACCCTAAGGCCCAGT

TTGCACGGCGGAGAACAGCTGTGCAGCCACGCTGGACACTCACCCCGCCCGAGTTGAGCCCGCCCCCGGGAC

TACAGGACCAATAAGTGATGAATATACCCGCGCGTCACGGAGCACCGGCCAATCGCGGACGGCCACGACCCT

AGAAAGGCTGGGCGCGGCAGGAGGCCACGGGGCGGTGGCGGCGCTGGCGTAGACGTTTCCTGGCTATGGT

GGTGGTGGCAGCGGCGCCGAGCGCGGCCACGGCGGCCCCCAAAGTGCTACTCTTATCTGGCCAGCCCGCCTC

CGGCGGCCGGGCGCTGCCGCTCATGGTACCCGGTCCGCGGGCAGCAGGGTCGGAGGCGAGCGGGACACCG

CAGGCTCGCAAGCGGCAGCGGCTCACGCACCTGAGCCCGGAGGAGAAAGCGCTGCGGAGGAAACTGAAAAA

CAGAGTAGCAGCGCAGACTGCTCGAGATAGAAAGAAAGCCCGGATGAGCGAGCTGGAGCAGCAAGTGGTG

GATTTGGAAGAAGAGAACCACAAACTCCAGCTAGAAAATCAGCTTTTACGGGAGAAAACTCACGGCCTTGTG

GTTGAGAACCAGGAGTTAAGAACACGCTTGGGAATGGACACGCTGGATCCTGACGAGGTTCCAGAGGTGGA

GGCCAAGGGGAGTGGAGTAAGGCTGGTGGCCGGGTCTGCTGAGTCCGCAGCACTCAGACTATGTGCACCTCT

GCAGCAGGTGCAGGCCCAGTTGTCACCTCCCCAGAACATCTTCCCATGGACTCTGACACTGTTGCCTCTTCAGA

TTCTGAGTCTGATATCCTTTTGGGCATTCTGGACAAGTTGGACCCTGTCATGTTTTTCAAATGTCCTTCCCCAGA

GTCTGCTAGTCTGGAGGAACTCCCAGAGGTCTACCCAGAAGGACCTAGTTCCTTACCAGCCTCCCTTTCTCTGT

-continued

CAGTGGGGACCTCATCAGCCAAGCTGGAAGCCATTAATGAACTCATTCGTTTTGACCATGTATACACCAAGCC

TCTAGTTTTAGAGATCCCCTCTGAGACAGAGAGTCAAACTAACGTGGTAGTGAAAATTGAGGAAGCACCTCTA

AGCTCTTCAGAAGAGGATCACCCTGAATTCATTGTCTCAGTGAAGAAAGAGCCTTTGGAAGATGACTTCATCC

CAGAGCTGGGCATCTCAAACCTGCTTTCATCCAGCCATTGTCTGAGACCACCTTCTTGCCTGCTGGACGCTCAC

AGTGACTGTGGATATGAGGGCTCCCCTTCTCCCTTCAGTGACATGTCTTCTCCACTTGGTACAGACCACTCCTG

GGAGGATACTTTTGCCAATGAACTTTTCCCCCAGCTGATTAGTGTCTAAAGAGCCACATAACACTGGGCCCCTT

TCCCTGACCATCACATTGCCTAGAGGATAGCATAGGCCTGTCTCTTTCGTTAAAAGCCAAAGTAGAGGCTGTCT

GGCCTTAGAAGAATTCCTCTAAAGTATTTCAAATCTCATAGATGACTTCCAAGTATTGTCGTTTGACACTCAGCT

GTCTAAGGTATTCAAAGGTATTCCAGTACTACAGCTTTTGAGATTCTAGTTTATCTTAAAGGTGGTAGTATACT

CTAAATCGCAGGGAGGGTCATTTGACAGTTTTTTCCCAGCCTGGCTTCAAACTATGTAGCCGAGGCTAGGCAG

AAACTTCTGACCCTCTTGACCCCACCTCCCAAGTGCTGGGCTTCACCAGGTGTGCACCTCCACACCTGCCCCCC

CGACATGTCAGGTGGACATGGGATTCATGAATGGCCCTTAGCATTTCTTTCTCCACTCTCTGCTTCCCAGGTTTC

GTAACCTGAGGGGGCTTGTTTTCCCTTATGTGCATTTTAAATGAAGATCAAGAATCTTTGTAAAATGATGAAAA

TTTACTATGTAAATGCTTGATGGATCTTCTTGCTAGTGTAGCTTCTAGAAGGTGCTTTCTCCATTTATTTAAAAC

TACCCTTGCAATTAAAAAAAAAGCAACACAGCGTCCTGTTCTGTGATTTCTAGGGCTGTTGTAATTTCTCTTTAT

TGTTGGCTAAAGGAGTAATTTATCCAACTAAAGTGAGCATACCACTTTTTAAAGTCAAAAAAAAAAAAAAAAAA

SEQ ID 592: Mouse X-box-binding protein 1 isoform XBP1(U)
MVVVAAAPSAATAAPKVLLLSGQPASGGRALPLMVPGPRAAGSEASGTPQARKRQRLTHLSPEEKALRRKLKNRV

AAQTARDRKKARMSELEQQVVDLEEENHKLQLENQLLREKTHGLVVENQELRTRLGMDTLDPDEVPEVEAKGSG

VRLVAGSAESAALRLCAPLQQVQAQLSPPQNIFPWTLTLLPLQILSLISFWAFWTSWTLSCFSNVLPQSLLVWRNSQ

RSTQKDLVPYQPPFLCQWGPHQPSWKPLMNSFVLTMYTPSL

SEQ ID 593: Mouse X-box binding protein 1 (Xbp1), transcript variant 2, mRNA
CTAGGGTAAAACCGTGAGACTCGGTCTGGAAATCTGGCCTGAGAGGACAGCCTGGCAATCCTCAGCCGGGGT

GGGGACGTCTGCCGAAGATCCTTGGACTCCAGCAACCAGTGGTCGCCACCGTCCATCCACCCTAAGGCCCAGT

TTGCACGGCGGAGAACAGCTGTGCAGCCACGCTGGACACTCACCCCGCCCGAGTTGAGCCCGCCCCCGGGAC

TACAGGACCAATAAGTGATGAATATACCCGCGCGTCACGGAGCACCGGCCAATCGCGGACGGCCACGACCCT

AGAAAGGCTGGGCGCGGCAGGAGGCCACGGGGCGGTGGCGGCGCTGGCGTAGACGTTTCCTGGCTATGGT

GGTGGTGGCAGCGGCGCCGAGCGCGGCCACGGCGGCCCCCAAAGTGCTACTCTTATCTGGCCAGCCCGCCTC

CGGCGGCCGGGCGCTGCCGCTCATGGTACCCGGTCCGCGGGCAGCAGGGTCGGAGGCGAGCGGGACACCG

CAGGCTCGCAAGCGGCAGCGGCTCACGCACCTGAGCCCGGAGGAGAAAGCGCTGCGGAGGAAACTGAAAAA

CAGAGTAGCAGCGCAGACTGCTCGAGATAGAAAGAAAGCCCGGATGAGCGAGCTGGAGCAGCAAGTGGTG

GATTTGGAAGAAGAGAACCACAAACTCCAGCTAGAAAATCAGCTTTTACGGGAGAAAACTCACGGCCTTGTG

GTTGAGAACCAGGAGTTAAGAACACGCTTGGGAATGGACACGCTGGATCCTGACGAGGTTCCAGAGGTGGA

GGCCAAGGGGAGTGGAGTAAGGCTGGTGGCCGGGTCTGCTGAGTCCGCAGCAGGTGCAGGCCCAGTTGTCA

CCTCCCCAGAACATCTTCCCATGGACTCTGACACTGTTGCCTCTTCAGATTCTGAGTCTGATATCCTTTTGGGCA

TTCTGGACAAGTTGGACCCTGTCATGTTTTTCAAATGTCCTTCCCCAGAGTCTGCTAGTCTGGAGGAACTCCCA

GAGGTCTACCCAGAAGGACCTAGTTCCTTACCAGCCTCCCTTTCTCTGTCAGTGGGGACCTCATCAGCCAAGCT

GGAAGCCATTAATGAACTCATTCGTTTTGACCATGTATACACCAAGCCTCTAGTTTTAGAGATCCCCTCTGAGA

CAGAGAGTCAAACTAACGTGGTAGTGAAAATTGAGGAAGCACCTCTAAGCTCTTCAGAAGAGGATCACCCTG

AATTCATTGTCTCAGTGAAGAAAGAGCCTTTGGAAGATGACTTCATCCCAGAGCTGGGCATCTCAAACCTGCT

TTCATCCAGCCATTGTCTGAGACCACCTTCTTGCCTGCTGGACGCTCACAGTGACTGTGGATATGAGGGCTCCC

-continued

CTTCTCCCTTCAGTGACATGTCTTCTCCACTTGGTACAGACCACTCCTGGGAGGATACTTTTGCCAATGAACTTT

TCCCCCAGCTGATTAGTGTCTAAAGAGCCACATAACACTGGGCCCCTTTCCCTGACCATCACATTGCCTAGAGG

ATAGCATAGGCCTGTCTCTTTCGTTAAAAGCCAAAGTAGAGGCTGTCTGGCCTTAGAAGAATTCCTCTAAAGT

ATTTCAAATCTCATAGATGACTTCCAAGTATTGTCGTTTGACACTCAGCTGTCTAAGGTATTCAAAGGTATTCCA

GTACTACAGCTTTTGAGATTCTAGTTTATCTTAAAGGTGGTAGTATACTCTAAATCGCAGGGAGGGTCATTTGA

CAGTTTTTTCCCAGCCTGGCTTCAAACTATGTAGCCGAGGCTAGGCAGAAACTTCTGACCCTCTTGACCCCACC

TCCCAAGTGCTGGGCTTCACCAGGTGTGCACCTCCACACCTGCCCCCCCGACATGTCAGGTGGACATGGGATT

CATGAATGGCCCTTAGCATTTCTTTCTCCACTCTCTGCTTCCCAGGTTTCGTAACCTGAGGGGGCTTGTTTTCCC

TTATGTGCATTTTAAATGAAGATCAAGAATCTTTGTAAAATGATGAAAATTTACTATGTAAATGCTTGATGGAT

CTTCTTGCTAGTGTAGCTTCTAGAAGGTGCTTTCTCCATTTATTTAAAACTACCCTTGCAATTAAAAAAAAAGCA

ACACAGCGTCCTGTTCTGTGATTTCTAGGGCTGTTGTAATTTCTCTTTATTGTTGGCTAAAGGAGTAATTTATCC

AACTAAAGTGAGCATACCACTTTTTAAAGTCAAAAAAAAAAAAAAAAAA

SEQ ID 594: X-box-binding protein 1 isoform XBP1(S)
MVVVAAAPSAATAAPKVLLLSGQPASGGRALPLMVPGPRAAGSEASGTPQARKRQRLTHLSPEEKALRRKLKNRV

AAQTARDRKKARMSELEQQVVDLEEENHKLQLENQLLREKTHGLVVENQELRTRLGMDTLDPDEVPEVEAKGSG

VRLVAGSAESAAGAGPVVTSPEHLPMDSDTVASSDSESDILLGILDKLDPVMFFKCPSPESASLEELPEVYPEGPSSL

PASLSLSVGTSSAKLEAINELIRFDHVYTKPLVLEIPSETESQTNVVVKIEEAPLSSSEEDHPEFIVSVKKEPLEDDFIPEL

GISNLLSSSHCLRPPSCLLDAHSDCGYEGSPSPFSDMSSPLGTDHSWEDTFANELFPQLISV

SEQ ID 595: Mouse XBP1 delta 4 mRNA
CTAGGGTAAAACCGTGAGACTCGGTCTGGAAATCTGGCCTGAGAGGACAGCCTGGCAATCCTCAGCCGGGGT

GGGGACGTCTGCCGAAGATCCTTGGACTCCAGCAACCAGTGGTCGCCACCGTCCATCCACCCTAAGGCCCAGT

TTGCACGGCGGAGAACAGCTGTGCAGCCACGCTGGACACTCACCCCGCCCGAGTTGAGCCCGCCCCCGGGAC

TACAGGACCAATAAGTGATGAATATACCCGCGCGTCACGGAGCACCGGCCAATCGCGGACGGCCACGACCCT

AGAAAGGCTGGGCGCGGCAGGAGGCCACGGGGCGGTGGCGGCGCTGGCGTAGACGTTTCCTGGCTATGGT

GGTGGTGGCAGCGGCGCCGAGCGCGGCCACGGCGGCCCCCAAAGTGCTACTCTTATCTGGCCAGCCCGCCTC

CGGCGGCCGGGCGCTGCCGCTCATGGTACCCGGTCCGCGGGCAGCAGGGTCGGAGGCGAGCGGGACACCG

CAGGCTCGCAAGCGGCAGCGGCTCACGCACCTGAGCCCGGAGGAGAAAGCGCTGCGGAGGAAACTGAAAAA

CAGAGTAGCAGCGCAGACTGCTCGAGATAGAAAGAAAGCCCGGATGAGCGAGCTGGAGCAGCAAGTGGTG

GATTTGGAAGAAGAGAACCACAAACTCCAGCTAGAAAATCAGCTTTTACGGGAGAAAACTCACGGCCTTGTG

GTTGAGAACCAGGAGTTAAGAACACGCTTGGGAATGGACACGCTGGATCCTGACGAGGTTCCAGAGGTGGA

GGCCAAGTCTGATATCCTTTTGGGCATTCTGGACAAGTTGGACCCTGTCATGTTTTTCAAATGTCCTTCCCCAG

AGTCTGCTAGTCTGGAGGAACTCCCAGAGGTCTACCCAGAAGGACCTAGTTCCTTACCAGCCTCCCTTTCTCTG

TCAGTGGGGACCTCATCAGCCAAGCTGGAAGCCATTAATGAACTCATTCGTTTTGACCATGTATACACCAAGC

CTCTAGTTTTAGAGATCCCCTCTGAGACAGAGAGTCAAACTAACGTGGTAGTGAAAATTGAGGAAGCACCTCT

AAGCTCTTCAGAAGAGGATCACCCTGAATTCATTGTCTCAGTGAAGAAAGAGCCTTTGGAAGATGACTTCATC

CCAGAGCTGGGCATCTCAAACCTGCTTTCATCCAGCCATTGTCTGAGACCACCTTCTTGCCTGCTGGACGCTCA

CAGTGACTGTGGATATGAGGGCTCCCCTTCTCCCTTCAGTGACATGTCTTCTCCACTTGGTACAGACCACTCCT

GGGAGGATACTTTTGCCAATGAACTTTTCCCCCAGCTGATTAGTGTCTAAAGAGCCACATAACACTGGGCCCCT

TTCCCTGACCATCACATTGCCTAGAGGATAGCATAGGCCTGTCTCTTTCGTTAAAAGCCAAAGTAGAGGCTGTC

TGGCCTTAGAAGAATTCCTCTAAAGTATTTCAAATCTCATAGATGACTTCCAAGTATTGTCGTTTGACACTCAGC

TGTCTAAGGTATTCAAAGGTATTCCAGTACTACAGCTTTTGAGATTCTAGTTTATCTTAAAGGTGGTAGTATAC

TCTAAATCGCAGGGAGGGTCATTTGACAGTTTTTTCCCAGCCTGGCTTCAAACTATGTAGCCGAGGCTAGGCA

-continued

GAAACTTCTGACCCTCTTGACCCCACCTCCCAAGTGCTGGGCTTCACCAGGTGTGCACCTCCACACCTGCCCCC

CCGACATGTCAGGTGGACATGGGATTCATGAATGGCCCTTAGCATTTCTTTCTCCACTCTCTGCTTCCCAGGTTT

CGTAACCTGAGGGGGCTTGTTTTCCCTTATGTGCATTTTAAATGAAGATCAAGAATCTTTGTAAAATGATGAAA

ATTTACTATGTAAATGCTTGATGGATCTTCTTGCTAGTGTAGCTTCTAGAAGGTGCTTTCTCCATTTATTTAAAA

CTACCCTTGCAATTAAAAAAAAAGCAACACAGCGTCCTGTTCTGTGATTTCTAGGGCTGTTGTAATTTCTCTTTA

TTGTTGGCTAAAGGAGTAATTTATCCAACTAAAGTGAGCATACCACTTTTTAAAGTCAAAAAAAAAAAAAAAAAA

SEQ ID 596: protein predicted to be produced by the XBP1 delta 4 mRNA
MVVVAAAPSAATAAPKVLLLSGQPASGGRALPLMVPGPRAAGSEASGTPQARKRQRLTHLSPEEKALRRKLKNRV

AAQTARDRKKARMSELEQQVVDLEEENHKLQLENQLLREKTHGLVVENQELRTRLGMDTLDPDEVPEVEAKSDIL

LGILDKLDPVMFFKCPSPESASLEELPEVYPEGPSSLPASLSLSVGTSSAKLEAINELIRFDHVYTKPLVLEIPSETESQTN

VVVKIEEAPLSSSEEDHPEFIVSVKKEPLEDDFIPELGISNLLSSSHCLRPPSCLLDAHSDCGYEGSPSPFSDMSSPLGTD

HSWEDTFANELFPQLISV

HUMAN
SEQ ID 801: Human XBP1 gene
GCTGGGCGGCTGCGGCGCGCGGTGCGCGGTGCGTAGTCTGGAGCTATGGTGGTGGTGGCAGCCGCGCCGAA

CCCGGCCGACGGGACCCCTAAAGTTCTGCTTCTGTCGGGGCAGCCCGCCTCCGCCGCCGGAGCCCCGGCCGG

CCAGGCCCTGCCGCTCATGGTGCCAGCCCAGAGAGGGGCCAGCCCGGAGGCAGCGAGCGGGGGGCTGCCCC

AGGCGCGCAAGCGACAGCGCCTCACGCACCTGAGCCCCGAGGAGAAGGCGCTGAGGAGGTGGGCGAGGGG

CCGGGGTCTGGGGCCAGATCTGAAGCCGGGACTAGGGACAGGGGCAGGGGCAGGGGCTGGGAGCGGGGA

CCCAGCACTGGCCGCCCCGCAGGGCTCCGTCGCCTTTGGCCTGGCGGGTCGGTGCCAGCGTGGCGCGGGGC

GGGGCAGGAAGCCCGGACTGACCGGATCCGCCACGCTGGGAACCTAGGGCGGCCCAGGGCTCTTTTCTGTAC

TTTTTAACTCTCTCGTTAGAGATGACCAGAGCTGGGGATGCGGGCACCTGTCTTCCAGGCCCTCTTGCTGTGTG

GCCGCAGACTGGTGGTTCAGCCTCTTAACTCGGACATGAGGTCGAATAATCTGTTTTGGTTTACTGCTATTTCT

GGAGAGGCGCGGAGCTGAAATAACAGAGCTGTTGAAAGGGCTGGGAATTCTGCGAGGCTCACTGGTCTAGC

TCAGTATCTGCGTTCTTAAAATGGAACCTACTTCATGAGGTCTTTGGGGAGATTGAGACTTGGATATAATGTG

CCTAGCACTTAGTCCTCCGTAAATGTTCACTCTTTTGTGATCATTGTGCCTTCTGTGATTTATGAAGTGTCTCTTC

TGAGTTAATTCTTTTAAAAAAAAAAGTGTCTCCTCCAACAGACACGGACCCATCAGCAGGTCACTGCCTAGGA

TCTCAACACTAGAGATCAGGGAGTGGCATCAGCCTCTCCCTTTTCTAAATTGGACTGGGGGACGGAGGGTTGA

TGTCATAGCAAGATTGCAGCCTTCACTAGATTAATGAGGCCAGGTTGGATCCTGTTTAAGAGAACTGGAGACA

GGAAGCAGCGGGGGAATAGATGGGGAAAGAGGAAAGTTCCTTATGATGCAAGATGAATAGTGTGTGTGTCC

AGCCCCAGTGCTGTGACGGGGATGAGTCTGAGGTGGACGGATGATGCAATATAGGAGAGAATAAAGCAGGT

CTTCGAGCTAGATTGACAGAAGACTGTATTTTTTATTTTGTTTTATTGAGGGGAGGAGCCTGAAGTGTATTTTA

TCATTAGTCTGTCTTATACTGTAAATAAAAATGAAAGCACCAGCTGGTAAAGTTTTCAAATAAAGACATAAATA

AGGTTTGATATGACTCAGTGTGGTATGTTCCTTCTCTTCCTAGGAAACTGAAAAACAGAGTAGCAGCTCAGAC

TGCCAGAGATCGAAAGAAGGCTCGAATGAGTGAGCTGGAACAGCAAGTGGTAGATTTAGAAGAAGAGGTAA

AACTACTTAAGGTCAAACTCTTTTATCCATTGTATACCCTTCCTTGGTGAATGTTCTGATATTTGCTTCCCATCCC

AAGTTGTTTCAGCCCCTATTAGAATACAATTGAATATATGATTAAAAGTTAAACTAGGCTGGGCATGGTGGCT

CATGCCTGTAATCCCAGCACTTTGGGAGCCTGAGTTGGGCAGATCACTTGAAGCCAGCAGTTTGAGACCAGCC

TAGCCAACATGGTAAAATCCCGTCTCTACCCAAAAATATACCAAAAAAAAAAAAAAAAAAAAAGGCCAAGCGT

GAGTGCCTGTAGTCCCAGCTACTCGGGAGGTTGAGGTGGGAGGATTGTTTGAACCTGGGAGAGGGGAGGTTG

CAGTGAGCTGAGATCGCACCACTGCACTCCAGCCTGGGCAACAGAGTGAGACTCTGTCTCAAGAAAAAAAAA

AAAAGTTTGCTGGGCACCGGGGCTCACACCTGTAATCCCAGCACTTTGGGAGGCCAAGGTGGGTAGATAACT

-continued

TGAGATCAGGAGTTCGAGACCAGCCTGACCAACGTGGTGAAACCCCATCTCTATTAAAAATACAAAAATTAGC

CGGGTGTCGTGGCAGGCACCTGTAATCCCAGCTGCTCCGGAGGCTGACGCAGGAGAATCACTTGAACCCAGG

AGGCGGAGGTTGCAGTGAGCTGAGATCACGAGATCATGCCACTGCACTCCAGTCTGGGCGACAGAGCAAAA

ACCCTGTCTCAAAAAAAAAAAAAAAAGTTAATCTAAGTTAGGACAGAGAGTTGGTGAAGTGGTGAAGCTTGTT

GAGGGCAGAAGTGATTGACTTTGTGGCATTTGGTGCTAGATGTATCTCAAAGTAGATGGATTTAACAATGTTT

ATTGAGTTTGTAGTAAGAAATTAGCAAGGGCTAATAGGAAATAATTGCTTAAACTTTACATTCTTCCTGGCATG

GCCAGAAATTCACTAAAGGTTCCTTTCCCCCTCTAGGGTCCACCTGTTAATCAATCTTAAATTGTTGCCAATTAC

ACATCTTGAATACATAGAGATTATTTATATTGTTTTTTTAACCCCTTGGTCAATTTGCATATATTGAGCTTTTTAA

AGTTTTAATCATTAGTTGGTTCTTCTAAGAATCATGAGTCAGGAGCAGGGATTTTTTTAACTTATTTTGGATTT

ATAGTCACCACTACCACTTTTATTATTACCTGCCAGTTCAAGATAGTTATTTATTTTTATTTTATATTATTATTATT

ATTATTATCATCATCATTATTTTGAGATGGAGTCTCACTCTGTTGCCCAGGCTGGAGTGCAGTGGTGCAATCTC

GGCTCACTGCAACCTCTGCCTCCCAGGTTCAAGCAATTCTCCCTGCTTCAGCCTCCAGATTAGCTGGGATTACA

GGCACCCCTCACCACATCCAGCTAATTTTTGGATTTTTTAGTAGAGATGGGGGTTTGCCATGTTGGCCAGGCTG

GTTTTGAACTCTTGACCTCAGGTGATCCACCTGCCTTGGCCTCCCAAAGTGTTAGGATTACAAGTGTGAGCCAC

CGAGCCTGGCCAAGATAGTTTAAAAAAAAAATTATATCTACATTAAAGCCACAAGTCACCCTTTGCTGAAGTCA

GTATTAGTAGTTGGAAGCAGTGTGTTATTCTTGACCCCATGAAGTGGCACTTATTAAGTAGCTTGCTTTTCCAT

AATTATGGCCTAGCTTTTTAAAACCTACTATGAACACCACAAGCATAGAGTTTTCCAAAAGTTCAAGAAGGAAA

GGAAACCAATTATACTGAATCAGGTAGATTCTTAACTGAAATAATTAGATGTTTTAATAGCCTCTTATGAACTT

TCTTCCAGAACCAAAAACTTTTGCTAGAAAATCAGCTTTTACGAGAGAAAACTCATGGCCTTGTAGTTGAGAAC

CAGGAGTTAAGACAGCGCTTGGGGATGGATGCCCTGGTTGCTGAAGAGGAGGCGGAAGCCAAGGTAAATCA

TCTCCTTTATTTGGTGCCTCATGTGAGTACTGGTTCCAAGTGACATGACCCAGCGATTATGTTTACAGTCTGGA

CTTCTGATCAAGAGCGTTCTTGAAATTTTCCTTCAGTTTTAAGACATTTTCATGCAGGCAGAGTGTTCTTCCCCT

AAAGGCACTTGACACTCATTTTTTAAGTGTGTAGTGAACAGTACTAAGATCTAATAATGAAAACAAGTTACAT

GGCTCCCTAAGAACAAGTACTAACAAATGCAGTAGCCAACAAGATTACCATGCAATCATTAAGGAGAACCAAA

GTAAGAGAGCCACTCAAACCAGATTTTGAACGCTACTAAAATTAAAGTAGTTCTTTGATGAATATGAATGAGT

AGGGAAAGGATTCTTTGTAATAGTGATACCTCTGTGGTAAGAGAAGGGTGGTATGTGAGTTTTAGTCTACAG

ATTATGGCAAATTCAGTGACAACAATCAAATGGTCTAAGATTGACAGTAGCACAGTTTTACTCTGTGAAGGTA

ATGTTCAGGACAAATTTCAAGAAAACTAGAAAACCATTCTTTACAGCTGAAATCTTTCCCTAACCATTGTTATTT

CCACTTTTAAGTCCTCAAGAGATGAGAAAAGGGAGGTAAGGCTTCCTTATACATTTCCTGCACAATGAAACAT

TTTTCCTCCTCCAGGCAAAGATTCAAGCAGAACTGGCAAATATCTTATCTTGCTCTTCTCAATAATAATAATGTT

GTTAGATAATAAAGTTCTATAGCAATTTAACCCTAGAATCTTTTTGAAAAGTAATTCTTTAAAGTTGAGAATCA

CAGCTGTCTAGCAAGCATTTCCTTGGGCACTTGAAGCTGTTTATTCACTTTGGTCTTTCCTCCCAGGGGAATGA

AGTGAGGCCAGTGGCCGGGTCTGCTGAGTCCGCAGCACTCAGACTACGTGCACCTCTGCAGCAGGTGCAGGC

CCAGTTGTCACCCCTCCAGAACATCTCCCCATGGATTCTGGCGGTATTGACTCTTCAGATTCAGAGGTAGGGAT

CATTCTGACTTATTAAAGAGCTATATAACCAGTTAATTCCATCTGTTTGATGCTTGACATCCCTAACTAGACAGA

TGAGGGTTGAAGTTAGTTTTTGGTGGGGTTGGAGGTGAACATCAACTACCTTCCTAGTTCCAGGTAATATAGA

ACATGGAGTGAAGTGTAGATAAATGGGTCTGGTGGGTCCCGAGGTCATCTTATCACATAATGACTAATTTACA

TTATGGAACCCAGTACAAAGTGTTCCAGTTAGATTTTCCATTGTATTCTGACAGTTGTACTTCATTTAATTTTTG

CCTCTTACAGTCTGATATCCTGTTGGGCATTCTGGACAACTTGGACCCAGTCATGTTCTTCAAATGCCCTTCCCC

AGAGCCTGCCAGCCTGGAGGAGCTCCCAGAGGTCTACCCAGAAGGACCCAGTTCCTTACCAGCCTCCCTTTCT

-continued

CTGTCAGTGGGGACGTCATCAGCCAAGCTGGAAGCCATTAATGAACTAATTCGTTTTGACCACATATATACCA

AGCCCCTAGTCTTAGAGATACCCTCTGAGACAGAGAGCCAAGCTAATGTGGTAGTGAAAATCGAGGAAGCAC

CTCTCAGCCCCTCAGAGAATGATCACCCTGAATTCATTGTCTCAGTGAAGGAAGAACCTGTAGAAGATGACCT

CGTTCCGGAGCTGGGTATCTCAAATCTGCTTTCATCCAGCCACTGCCCAAAGCCATCTTCCTGCCTACTGGATG

CTTACAGTGACTGTGGATACGGGGGTTCCCTTTCCCCATTCAGTGACATGTCCTCTCTGCTTGGTGTAAACCAT

TCTTGGGAGGACACTTTTGCCAATGAACTCTTTCCCCAGCTGATTAGTGTCTAAGGAATGATCCAATACTGTTG

CCCTTTTCCTTGACTATTACACTGCCTGGAGGATAGCAGAGAAGCCTGTCTGTACTTCATTCAAAAAGCCAAAA

TAGAGAGTATACAGTCCTAGAGAATTCCTCTATTTGTTCAGATCTCATAGATGACCCCCAGGTATTGTCTTTTG

ACATCCAGCAGTCCAAGGTATTGAGACATATTACTGGAAGTAAGAAATATTACTATAATTGAGAACTACAGCT

TTTAAGATTGTACTTTTATCTTAAAAGGGTGGTAGTTTTCCCTAAAATACTTATTATGTAAGGGTCATTAGACAA

ATGTCTTGAAGTAGACATGGAATTTATGAATGGTTCTTTATCATTTCTCTTCCCCCTTTTTGGCATCCTGGCTTG

CCTCCAGTTTTAGGTCCTTTAGTTTGCTTCTGTAAGCAACGGGAACACCTGCTGAGGGGGCTCTTTCCCTCATG

TATACTTCAAGTAAGATCAAGAATCTTTTGTGAAATTATAGAAATTTACTATGTAAATGCTTGATGGAATTTTTT

CCTGCTAGTGTAGCTTCTGAAAGGTGCTTTCTCCATTTATTTAAAACTACCCATGCAATTAAAAGGTACAATGCA

SEQ ID 802: Human X-box binding protein 1 (XBP1), transcript variant 1, mRNA (not processed by IRE1)

GCTGGGCGGCTGCGGCGCGCGGTGCGCGGTGCGTAGTCTGGAGCTATGGTGGTGGCAGCCGCGCCGAA

CCCGGCCGACGGGACCCCTAAAGTTCTGCTTCTGTCGGGGCAGCCCGCCTCCGCCGCCGGAGCCCCGGCCGG

CCAGGCCCTGCCGCTCATGGTGCCAGCCCAGAGAGGGGCCAGCCCGGAGGCAGCGAGCGGGGGGCTGCCCC

AGGCGCGCAAGCGACAGCGCCTCACGCACCTGAGCCCCGAGGAGAAGGCGCTGAGGAGGAAACTGAAAAAC

AGAGTAGCAGCTCAGACTGCCAGAGATCGAAAGAAGGCTCGAATGAGTGAGCTGGAACAGCAAGTGGTAGA

TTTAGAAGAAGAGAACCAAAAACTTTTGCTAGAAAATCAGCTTTTACGAGAGAAAACTCATGGCCTTGTAGTT

GAGAACCAGGAGTTAAGACAGCGCTTGGGGATGGATGCCCTGGTTGCTGAAGAGGAGGCGGAAGCCAAGG

GGAATGAAGTGAGGCCAGTGGCCGGGTCTGCTGAGTCCGCAGCACTCAGACTACGTGCACCTCTGCAGCAGG

TGCAGGCCCAGTTGTCACCCCTCCAGAACATCTCCCCATGGATTCTGGCGGTATTGACTCTTCAGATTCAGAGT

CTGATATCCTGTTGGGCATTCTGGACAACTTGGACCCAGTCATGTTCTTCAAATGCCCTTCCCCAGAGCCTGCC

AGCCTGGAGGAGCTCCCAGAGGTCTACCCAGAAGGACCCAGTTCCTTACCAGCCTCCCTTTCTCTGTCAGTGG

GGACGTCATCAGCCAAGCTGGAAGCCATTAATGAACTAATTCGTTTTGACCACATATATACCAAGCCCCTAGTC

TTAGAGATACCCTCTGAGACAGAGAGCCAAGCTAATGTGGTAGTGAAAATCGAGGAAGCACCTCTCAGCCCC

TCAGAGAATGATCACCCTGAATTCATTGTCTCAGTGAAGGAAGAACCTGTAGAAGATGACCTCGTTCCGGAGC

TGGGTATCTCAAATCTGCTTTCATCCAGCCACTGCCCAAAGCCATCTTCCTGCCTACTGGATGCTTACAGTGACT

GTGGATACGGGGGTTCCCTTTCCCCATTCAGTGACATGTCCTCTCTGCTTGGTGTAAACCATTCTTGGGAGGAC

ACTTTTGCCAATGAACTCTTTCCCCAGCTGATTAGTGTCTAAGGAATGATCCAATACTGTTGCCCTTTTCCTTGA

CTATTACACTGCCTGGAGGATAGCAGAGAAGCCTGTCTGTACTTCATTCAAAAAGCCAAAATAGAGAGTATAC

AGTCCTAGAGAATTCCTCTATTTGTTCAGATCTCATAGATGACCCCCAGGTATTGTCTTTTGACATCCAGCAGTC

CAAGGTATTGAGACATATTACTGGAAGTAAGAAATATTACTATAATTGAGAACTACAGCTTTTAAGATTGTACT

TTTATCTTAAAAGGGTGGTAGTTTTCCCTAAAATACTTATTATGTAAGGGTCATTAGACAAATGTCTTGAAGTA

GACATGGAATTTATGAATGGTTCTTTATCATTTCTCTTCCCCCTTTTTGGCATCCTGGCTTGCCTCCAGTTTTAGG

TCCTTTAGTTTGCTTCTGTAAGCAACGGGAACACCTGCTGAGGGGGCTCTTTCCCTCATGTATACTTCAAGTAA

GATCAAGAATCTTTTGTGAAATTATAGAAATTTACTATGTAAATGCTTGATGGAATTTTTTCCTGCTAGTGTAGC

TTCTGAAAGGTGCTTTCTCCATTTATTTAAAACTACCCATGCAATTAAAAGGTACAATGCA

SEQ ID 803: Human X-box-binding protein 1 isoform XBP1(U)

-continued

MVVVAAAPNPADGTPKVLLLSGQPASAAGAPAGQALPLMVPAQRGASPEAASGGLPQARKRQRLTHLSPEEKAL

RRKLKNRVAAQTARDRKKARMSELEQQVVDLEEENQKLLLENQLLREKTHGLVVENQELRQRLGMDALVAEEEAE

AKGNEVRPVAGSAESAALRLRAPLQQVQAQLSPLQNISPWILAVLTLQIQSLISCWAFWTTWTQSCSSNALPQSLP

AWRSSQRSTQKDPVPYQPPFLCQWGRHQPSWKPLMN

SEQ ID 804: Human X-box binding protein 1 (XBP1), transcript variant 2, mRNA (processed by IRE1)
GCTGGGCGGCTGCGGCGCGCGGTGCGCGGTGCGTAGTCTGGAGCTATGGTGGTGGTGGCAGCCGCGCCGAA

CCCGGCCGACGGGACCCCTAAAGTTCTGCTTCTGTCGGGGCAGCCCGCCTCCGCCGCCGGAGCCCCGGCCGG

CCAGGCCCTGCCGCTCATGGTGCCAGCCCAGAGAGGGGCCAGCCCGGAGGCAGCGAGCGGGGGGCTGCCCC

AGGCGCGCAAGCGACAGCGCCTCACGCACCTGAGCCCCGAGGAGAAGGCGCTGAGGAGGAAACTGAAAAAC

AGAGTAGCAGCTCAGACTGCCAGAGATCGAAAGAAGGCTCGAATGAGTGAGCTGGAACAGCAAGTGGTAGA

TTTAGAAGAAGAGAACCAAAAACTTTTGCTAGAAAATCAGCTTTTACGAGAGAAAACTCATGGCCTTGTAGTT

GAGAACCAGGAGTTAAGACAGCGCTTGGGGATGGATGCCCTGGTTGCTGAAGAGGAGGCGGAAGCCAAGG

GGAATGAAGTGAGGCCAGTGGCCGGGTCTGCTGAGTCCGCAGCAGGTGCAGGCCCAGTTGTCACCCCTCCAG

AACATCTCCCCATGGATTCTGGCGGTATTGACTCTTCAGATTCAGAGTCTGATATCCTGTTGGGCATTCTGGAC

AACTTGGACCCAGTCATGTTCTTCAAATGCCCTTCCCCAGAGCCTGCCAGCCTGGAGGAGCTCCCAGAGGTCT

ACCCAGAAGGACCCAGTTCCTTACCAGCCTCCCTTTCTCTGTCAGTGGGGACGTCATCAGCCAAGCTGGAAGC

CATTAATGAACTAATTCGTTTTGACCACATATATACCAAGCCCCTAGTCTTAGAGATACCCTCTGAGACAGAGA

GCCAAGCTAATGTGGTAGTGAAAATCGAGGAAGCACCTCTCAGCCCCTCAGAGAATGATCACCCTGAATTCAT

TGTCTCAGTGAAGGAAGAACCTGTAGAAGATGACCTCGTTCCGGAGCTGGGTATCTCAAATCTGCTTTCATCC

AGCCACTGCCCAAAGCCATCTTCCTGCCTACTGGATGCTTACAGTGACTGTGGATACGGGGGTTCCCTTTCCCC

ATTCAGTGACATGTCCTCTCTGCTTGGTGTAAACCATTCTTGGGAGGACACTTTTGCCAATGAACTCTTTCCCCA

GCTGATTAGTGTCTAAGGAATGATCCAATACTGTTGCCCTTTTCCTTGACTATTACACTGCCTGGAGGATAGCA

GAGAAGCCTGTCTGTACTTCATTCAAAAAGCCAAAATAGAGAGTATACAGTCCTAGAGAATTCCTCTATTTGTT

CAGATCTCATAGATGACCCCCAGGTATTGTCTTTTGACATCCAGCAGTCCAAGGTATTGAGACATATTACTGGA

AGTAAGAAATATTACTATAATTGAGAACTACAGCTTTTAAGATTGTACTTTTATCTTAAAAGGGTGGTAGTTTT

CCCTAAAATACTTATTATGTAAGGGTCATTAGACAAATGTCTTGAAGTAGACATGGAATTTATGAATGGTTCTT

TATCATTTCTCTTCCCCCTTTTTGGCATCCTGGCTTGCCTCCAGTTTTAGGTCCTTTAGTTTGCTTCTGTAAGCAA

CGGGAACACCTGCTGAGGGGGCTCTTTCCCTCATGTATACTTCAAGTAAGATCAAGAATCTTTTGTGAAATTAT

AGAAATTTACTATGTAAATGCTTGATGGAATTTTTTCCTGCTAGTGTAGCTTCTGAAAGGTGCTTTCTCCATTTA

TTTAAAACTACCCATGCAATTAAAAGGTACAATGCA

SEQ ID 805: Human X-box-binding protein 1 isoform XBP1(S)
MVVVAAAPNPADGTPKVLLLSGQPASAAGAPAGQALPLMVPAQRGASPEAASGGLPQARKRQRLTHLSPEEKAL

RRKLKNRVAAQTARDRKKARMSELEQQVVDLEEENQKLLLENQLLREKTHGLVVENQELRQRLGMDALVAEEEAE

AKGNEVRPVAGSAESAAGAGPVVTPPEHLPMDSGGIDSSDSESDILLGILDNLDPVMFFKCPSPEPASLEELPEVYP

EGPSSLPASLSLSVGTSSAKLEAINELIRFDHIYTKPLVLEIPSETESQANVVVKIEEAPLSPSENDHPEFIVSVKEEPVED

DLVPELGISNLLSSSHCPKPSSCLLDAYSDCGYGGSLSPFSDMSSLLGVNHSWEDTFANELFPQLISV

SEQ ID 806: Human X-box binding protein 1 (XBP1) delta 4 variant
GCTGGGCGGCTGCGGCGCGCGGTGCGCGGTGCGTAGTCTGGAGCTATGGTGGTGGTGGCAGCCGCGCCGAA

CCCGGCCGACGGGACCCCTAAAGTTCTGCTTCTGTCGGGGCAGCCCGCCTCCGCCGCCGGAGCCCCGGCCGG

CCAGGCCCTGCCGCTCATGGTGCCAGCCCAGAGAGGGGCCAGCCCGGAGGCAGCGAGCGGGGGGCTGCCCC

AGGCGCGCAAGCGACAGCGCCTCACGCACCTGAGCCCCGAGGAGAAGGCGCTGAGGAGGAAACTGAAAAAC

AGAGTAGCAGCTCAGACTGCCAGAGATCGAAAGAAGGCTCGAATGAGTGAGCTGGAACAGCAAGTGGTAGA

-continued

TTTAGAAGAAGAGAACCAAAAACTTTTGCTAGAAAATCAGCTTTTACGAGAGAAAACTCATGGCCTTGTAGTT

GAGAACCAGGAGTTAAGACAGCGCTTGGGGATGGATGCCCTGGTTGCTGAAGAGGAGGCGGAAGCCAAGTC

TGATATCCTGTTGGGCATTCTGGACAACTTGGACCCAGTCATGTTCTTCAAATGCCCTTCCCCAGAGCCTGCCA

GCCTGGAGGAGCTCCCAGAGGTCTACCCAGAAGGACCCAGTTCCTTACCAGCCTCCCTTTCTCTGTCAGTGGG

GACGTCATCAGCCAAGCTGGAAGCCATTAATGAACTAATTCGTTTTGACCACATATATACCAAGCCCCTAGTCT

TAGAGATACCCTCTGAGACAGAGAGCCAAGCTAATGTGGTAGTGAAAATCGAGGAAGCACCTCTCAGCCCCT

CAGAGAATGATCACCCTGAATTCATTGTCTCAGTGAAGGAAGAACCTGTAGAAGATGACCTCGTTCCGGAGCT

GGGTATCTCAAATCTGCTTTCATCCAGCCACTGCCCAAAGCCATCTTCCTGCCTACTGGATGCTTACAGTGACT

GTGGATACGGGGGTTCCCTTTCCCCATTCAGTGACATGTCCTCTCTGCTTGGTGTAAACCATTCTTGGGAGGAC

ACTTTTGCCAATGAACTCTTTCCCCAGCTGATTAGTGTCTAAGGAATGATCCAATACTGTTGCCCTTTTCCTTGA

CTATTACACTGCCTGGAGGATAGCAGAGAAGCCTGTCTGTACTTCATTCAAAAAGCCAAAATAGAGAGTATAC

AGTCCTAGAGAATTCCTCTATTTGTTCAGATCTCATAGATGACCCCCAGGTATTGTCTTTTGACATCCAGCAGTC

CAAGGTATTGAGACATATTACTGGAAGTAAGAAATATTACTATAATTGAGAACTACAGCTTTTAAGATTGTACT

TTTATCTTAAAAGGGTGGTAGTTTTCCCTAAAATACTTATTATGTAAGGGTCATTAGACAAATGTCTTGAAGTA

GACATGGAATTTATGAATGGTTCTTTATCATTTCTCTTCCCCCTTTTTGGCATCCTGGCTTGCCTCCAGTTTTAGG

TCCTTTAGTTTGCTTCTGTAAGCAACGGGAACACCTGCTGAGGGGGCTCTTTCCCTCATGTATACTTCAAGTAA

GATCAAGAATCTTTTGTGAAATTATAGAAATTTACTATGTAAATGCTTGATGGAATTTTTTCCTGCTAGTGTAGC

TTCTGAAAGGTGCTTTCTCCATTTATTTAAAACTACCCATGCAATTAAAAGGTACAATGCA

SEQ ID 807; Human Predicted amino acid sequence from XBP1 delta4 mRNA transcript (SEQ ID 562)
MVVVAAAPNPADGTPKVLLLSGQPASAAGAPAGQALPLMVPAQRGASPEAASGGLPQARKRQRLTHLSPEEKAL

RRKLKNRVAAQTARDRKKARMSELEQQVVDLEEENQKLLLENQLLREKTHGLVVENQELRQRLGMDALVAEEEAE

AKSDILLGILDNLDPVMFFKCPSPEPASLEELPEVYPEGPSSLPASLSLSVGTSSAKLEAINELIRFDHIYTKPLVLEIPSET

ESQANVVVKIEEAPLSPSENDHPEFIVSVKEEPVEDDLVPELGISNLLSSSHCPKPSSCLLDAYSDCGYGGSLSPFSDM

SSLLGVNHSWEDTFANELFPQLISV

SEQUENCE LISTING (1506 sequences)

SEQ ID NO: 1 - DNA, 4008 bp, Cricetulus griseus
  source 1..4008: mol_type = genomic DNA
atggtggtggtggcagcgtcgccgagcgcggccacggcggccccgaaagtactgcttctatcgggccagcccgccgcggacggccgggcgctgccactcatggttccaggctcgcgggcagcagggtccgaggcgaacggggcgccacaggctcgcaagcggcagcgcctcacgcacctgagcccggaggagaaggcgctgcggaggtgggctcggcgggcggggcggcaaggccgggcatgggaccctttctcgtgtggcggtcgggagggctctgtggggtggcgtagatgagcctctagtacctatttctggagggaggcacggagctgaggtgacagcccctccgaaggtctgcttagtctgtgtcggggagtctaacacttgtcagacgggacctgacgctcagccctctgtgaatgcttgctcttcttggaggacccatggcagggtccgctctggctgttgttgcagccgcttgggaacttaacactgggatccgagtcaccatcctccggcagcccgagttgagcttggggagggacggttggtagcgcccccgccgccttcacggagcctgttggacagaatcggaactagaaagccgcgggggaggagggaagatgcttatgacgcaacgggaatgtgtgtcagcccggtggtaaaataagactcgagtggacagcaacatgggagagaatcgagcaagtcttcaaggcccacgggcagaaaagctgtggtttttgtctttttgagaggaggagcctcagaatgtgtttaccactgtttagtcttattctgtaaagtcagcgaaagcaccagctggccacatttacaaatgaagatacaggaaagctgaagatgactcggttcgttatgtgccctgtcttccttcaggaaactgaaaaacagagtagcagcgcagactgcccgagatcgaaagaaagcccggatgagcgagctggaacagcaagtggtggatttggaagaagaggtaaagggatttaaggccatgctttcttctctgcccattctaagctgctgcagccctttagaatacaactaaagtgccatttaaagtttaactagcttagcagataggtggtgaaggcagacatgactcactcctgacagctagatactatcgatagaagttgctcagagattagccaggtcagatagatcctggcttaaccttcagtactcttgctcttgccaaaggctcactagaattgccttccttctagggttctcttgttatctaatctgagcaagggctattgttttaaaagttttaatcatcagctggttcttagaagaaatgtgggtcatatcagtagcagtttaaaaaaaatattttgttaggtatagcccaccattcccactttgtttttatactcagcatacagagtattaggacattttcaaacagcgtgttttagttaattgattcttcctgccattttccctacacccccagtatccttttaccttctcttggacttctagttgttttttaaggccttacacacatttacatccattcatatgcattcacactctcacacacagtaaggtctacatatgcaagaaactcttggttctgtttgggccacctcacttaaaatatttaacaaatctacacatcttcctgccaacttctattttctttatagccgagtaacattcttctgtgcacatgtaccatattttcatctgtttcattggtgtctcccaattgctggtgttacaggcatgagccacccatgctagttttatgtagagctggaggctgaacccagggcttcatgtgtagtagggcaagcactcttaccaactgatctacaccattagccaccagtgttgcaacagttatgaacgactgcatatgcacagaatttatcagttcaatgaggaaaccaactgtaacaaatcacgttttaatagcctcttctggattttcttacagaaccaaaaacttctgttagaaaatcagcttttgagagagaaaactcatggccttgtaattgagaaccaggagttaagaactcgcttgggaatggatgtgctgactactgaagaggctccagagacggagtccaaggtaaatcttatgagacttggttgtgacatgaacggattgtatttgtgatcccaacctctatcaagccttccttttctcttttccttcttttgagacagggtcttaatttcttaattttggatggtcttgaaattgtatcagttttatggcctctgcctccaaagtaatggaactagacatgtgccaccatgcctagctgatcagtcttgaaaatttctccacatttccaacagacctgttcagtcttcagtgactcattcttcaagtgtgtaatgaagtgttactaagccctaataatcctaataatttacatagctctctcagaataagtgctaacaccagtagccagcaagctataccatgcaggcatcaaatagaatgagactgtaagggctagtcagatttgggagattttgatcttgttttgagacagagtctctgtatataattaacccaggttggctttggactcatcctctggccatagcctcccaggtgctgggattttaggcactacaattggcttgtttcctggacttttgacagccctcatgtggcctaggttggtcttaaacttgatatgttagctgataattctgtctctgctttccaagtgttaagatacgggcacatactactttatctggcggagttatgtaggcatggtgtttgtgtacatgagtatcttactaaatctggagctaggctggtggctagcaaatcctggtgatcctcttgtctctgtctccctcagtgttggggttatacaggcacaactgtcatgctccaaattttacattgatgcttgcctaacaagcaggcttatgctctgagccacctcccatagcctggtgtgcatttccttggagtgttccctcactttggtctttccttccagggaaatggagtaaggccggtggccgggtctgctgagtccgcagcactcagactacgtgcacctctgcagcaggtgcaggcccagttgtcacctccccagaacatcttcccatggattctgacactgttgactcttcagactccgaggtagagcttgtttgccttactaaagcactgtgtaagattggctcattctgtagtatatatatgatgtgtgacatgcctagccaggcaaatggagaaagaagttagtattggtagggttaggggtaagcagtcactttcttaatttccagtggtttaggtcatggagtcgggagaagctgttctgatgggtgtgtccttcgatctgacagcataaggcctaactgacattgtggaactcagtactaagtgtttctggtagaccatcacattctaatagtgaactttttttgtcttacctcttgcagtctgatatccttttgggcattctggacaagttggaccctgtcatgtttttcaaatgtccatccccagagtctgccaatctggaggaactcccagaggtctacccaggacctagttccttaccagcctccctttctctgtcagtggggacctcatcagccaagctggaagccattaatgaactcattcgctttgaccatgtatacaccaagcctctagtcttagagatcccttctgagacagagagtcaaactaatgtggtagtgaaaattgaggaagcacctctcagctcttcagaggaggatcaccctgaattcattgtctcagtgaagaaagaacctttggaagaagacttcattccagagccgggcatctcaaacctgctttcatccagccactgtctgaaaccatcttcctgcctgctggatgcttatagtgactgtggatatgagggctccccttctcccttcagtgacatgtcttctccacttggtatagaccattcttgggaggacacttttgccaatgaactctttccccagctaattagtgtctaa

SEQ ID NO: 2 - DNA, 1139 bp, Cricetulus griseus
  source 1..1139: mol_type = genomic DNA
atggtggtggtggcagcggcgccgagcgcggccacggcggccccgaaagtactgcttctatcgggccagcccgccgcggacggccgggcgctgccactcatggttccaggctcgcgggcagcagggtccgaggcgaacggggcgccacaggctcgcaagcggcagcgcctcacgcacctgagcccggaggagaaggcgctgcggaggaaactgaaaaacagagtagcagcgcagactgcccgagatcgaaagaaagcccggatgagcgagctggaacagcaagtggtggatttggaagaagagaaccaaaaacttctgttagaaaatcagcttttgagagagaaaactcatggccttgtaattgagaaccaggagttaagaactcgcttgggaatggatgtgctgactactgaagaggctccagagacggagtccaagggaaatggagtaaggccggtggccgggtctgctgagtccgcagcactcagactacgtgcacctctgcagcaggtgcaggcccagttgtcacctccccagaacatcttcccatggattctgacactgttgactcttcagactccgagtctgatatccttttgggcattctggacaagttggaccctgtcatgtttttcaaatgtccatccccagagtctgccaatctggaggaactcccagaggtctacccaggacctagttccttaccagcctccctttctctgtcagtggggacctcatcagccaagctggaagccattaatgaactcattcgctttgaccatgtatacaccaagcctctagtcttagagatcccttctgagacagagagtcaaactaatgtggtagtgaaaattgaggaagcacctctcagctcttcagaggaggatcaccctgaattcattgtctcagtgaagaaagaacctttggaagaagacttcattccagagccgggcatctcaaacctgctttcatccagccactgtctgaaaccatcttcctgcctgctggatgcttatagtgactgtggatatgagggctccccttctcccttcagtgacatgtcttctccacttggtatagaccattcttgggaggacacttttgccaatgaactctttccccagctaattagtgtctaa

SEQ ID NO: 3 - protein, 266 aa, Cricetulus griseus
MVVVAAAPSAATAAPKVLLLSGQPAADGRALPLMVPGSRAAGSEANGAPQARKRQRLTHLSPEEKALRRKLKNRVAAQTARDRKKARMSELEQQVVDLEEENQKLLLENQLLREKTHGLVIENQELRTRLGMDVLTTEEAPETESKGNGVRPVAGSAESAALRLRAPLQQVQAQLSPPQNIFPWILTLLTLQTPSLISFWAFWTSWTLSCFSNVHPQSLPIWRNSQRSTQDLVPYQPPFLCQWGPHQPSWKPLMNSFALTMYTPSL

SEQ ID NO: 4 - DNA, 1113 bp, Cricetulus griseus
  source 1..1113: mol_type = genomic DNA
atggtggtggtggcagcgtcgccgagcgcggccacggcggccccgaaagtactgcttctatcgggccagcccgccgcggacggccgggcgctgccactcatggttccaggctcgcgggcagcagggtccgaggcgaacggggcgccacaggctcgcaagcggcagcgcctcacgcacctgagcccggaggagaaggcgctgcggaggaaactgaaaaacagagtagcagcgcagactgcccgagatcgaaagaaagcccggatgagcgagctggaacagcaagtggtggatttggaagaagagaaccaaaaacttctgttagaaaatcagcttttgagagagaaaactcatggccttgtaattgagaaccaggagttaagaactcgcttgggaatggatgtgctgactactgaagaggctccagagacggagtccaagggaaatggagtaaggccggtggccgggtctgctgagtccgcagcaggtgcaggcccagttgtcacctccccagaacatcttcccatggattctgacactgttgactcttcagactccgagtctgatatccttttgggcattctggacaagttggaccctgtcatgtttttcaaatgtccatccccagagtctgccaatctggaggaactcccagaggtctacccaggacctagttccttaccagcctccctttctctgtcagtggggacctcatcagccaagctggaagccattaatgaactcattcgctttgaccatgtatacaccaagcctctagtcttagagatcccttctgagacagagagtcaaactaatgtggtagtgaaaattgaggaagcacctctcagctcttcagaggaggatcaccctgaattcattgtctcagtgaagaaagaacctttggaagaagacttcattccagagccgggcatctcaaacctgctttcatccagccactgtctgaaaccatcttcctgcctgctggatgcttatagtgactgtggatatgagggctccccttctcccttcagtgacatgtcttctccacttggtatagaccattcttgggaggacacttttgccaatgaactctttccccagctgattagtgtctaa

SEQ ID NO: 5 - protein, 370 aa, Cricetulus griseus
MVVVAASPSAATAAPKVLLLSGQPAADGRALPLMVPGSRAAGSEANGAPQARKRQRLTHLSPEEKALRRKLKNRVAAQTARDRKKARMSELEQQVVDLEEENQKLLLENQLLREKTHGLVIENQELRTRLGMDVLTTEEAPETESKGNGVRPVAGSAESAAGAGPVVTSPEHLPMDSDTVDSSDSESDILLGILDKLDPVMFFKCPSPESANLEELPEVYPGPSSLPASLSLSVGTSSAKLEAINELIRFDHVYTKPLVLEIPSETESQTNVVVKIEEAPLSSSEEDHPEFIVSVKKEPLEEDFIPEPGISNLLSSSHCLKPSSCLLDAYSDCGYEGSPSPFSDMSSPLGIDHSWEDTFANELFPQLISV

SEQ ID NO: 6 - DNA, 993 bp, Cricetulus griseus
  source 1..993: mol_type = genomic DNA
atggtggtggtggcagcggcgccgagcgcggccacggcggccccgaaagtactgcttctatcgggccagcccgccgcggacggccgggcgctgccactcatggttccaggctcgcgggcagcagggtccgaggcgaacggggcgccacaggctcgcaagcggcagcgcctcacgcacctgagcccggaggagaaggcgctgcggaggaaactgaaaaacagagtagcagcgcagactgcccgagatcgaaagaaagcccggatgagcgagctggaacagcaagtggtggatttggaagaagagaaccaaaaacttctgttagaaaatcagcttttgagagagaaaactcatggccttgtaattgagaaccaggagttaagaactcgcttgggaatggatgtgctgactactgaagaggctccagagacggagtccaagtctgatatccttttgggcattctggacaagttggaccctgtcatgtttttcaaatgtccatccccagagtctgccaatctggaggaactcccagaggtctacccaggacctagttccttaccagcctccctttctctgtcagtggggacctcatcagccaagctggaagccattaatgaactcattcgctttgaccatgtatacaccaagcctctagtcttagagatcccttctgagacagagagtcaaactaatgtggtagtgaaaattgaggaagcacctctcagctcttcagaggaggatcaccctgaattcattgtctcagtgaagaaagaacctttggaagaagacttcattccagagccgggcatctcaaacctgctttcatccagccactgtctgaaaccatcttcctgcctgctggatgcttatagtgactgtggatatgagggctccccttctcccttcagtgacatgtcttctccacttggtatagaccattcttgggaggacacttttgccaatgaactctttccccagctaattagtgtctaa

SEQ ID NO: 7 - protein, 330 aa, Cricetulus griseus
MVVVAAAPSAATAAPKVLLLSGQPAADGRALPLMVPGSRAAGSEANGAPQARKRQRLTHLSPEEKALRRKLKNRVAAQTARDRKKARMSELEQQVVDLEEENQKLLLENQLLREKTHGLVIENQELRTRLGMDVLTTEEAPETESKSDILLGILDKLDPVMFFKCPSPESANLEELPEVYPGPSSLPASLSLSVGTSSAKLEAINELIRFDHVYTKPLVLEIPSETESQTNVVVKIEEAPLSSSEEDHPEFIVSVKKEPLEEDFIPEPGISNLLSSSHCLKPSSCLLDAYSDCGYEGSPSPFSDMSSPLGIDHSWEDTFANELFPQLISV

SEQ ID NO: 8 - DNA, 14 bp, synthetic construct
  misc_feature 1..14: note = motif sequence
  source 1..14: mol_type = other DNA
ccctggaaggaaag

SEQ ID NO: 9 - DNA, 14 bp, synthetic construct
  misc_feature 1..14: note = motif sequence
  source 1..14: mol_type = other DNA
ttccctggaaggaa

SEQ ID NO: 10 - DNA, 14 bp, synthetic construct
  misc_feature 1..14: note = motif sequence
  source 1..14: mol_type = other DNA
tttccctggaagga

SEQ ID NO: 11 - DNA, 14 bp, synthetic construct
  misc_feature 1..14: note = motif sequence
  source 1..14: mol_type = other DNA
atttccctggaagg

SEQ ID NO: 12 - DNA, 14 bp, synthetic construct
  misc_feature 1..14: note = motif sequence
  source 1..14: mol_type = other DNA
catttccctggaag

SEQ ID NO: 13 - DNA, 14 bp, synthetic construct
  misc_feature 1..14: note = motif sequence
  source 1..14: mol_type = other DNA
ccatttccctggaa

SEQ ID NO: 14 - DNA, 14 bp, synthetic construct
  misc_feature 1..14: note = motif sequence
  source 1..14: mol_type = other DNA
tccatttccctgga

SEQ ID NO: 15 - DNA, 14 bp, synthetic construct
  misc_feature 1..14: note = motif sequence
  source 1..14: mol_type = other DNA
ctccatttccctgg

SEQ ID NO: 16 - DNA, 14 bp, synthetic construct
  misc_feature 1..14: note = motif sequence
  source 1..14: mol_type = other DNA
actccatttccctg

SEQ ID NO: 17 - DNA, 14 bp, synthetic construct
  misc_feature 1..14: note = motif sequence
  source 1..14: mol_type = other DNA
tactccatttccct

SEQ ID NO: 18 - DNA, 14 bp, synthetic construct
  misc_feature 1..14: note = motif sequence
  source 1..14: mol_type = other DNA
ttactccatttccc

SEQ ID NO: 19 - DNA, 14 bp, synthetic construct
  misc_feature 1..14: note = motif sequence
  source 1..14: mol_type = other DNA
cttactccatttcc

SEQ ID NO: 20 - DNA, 14 bp, synthetic construct
  misc_feature 1..14: note = motif sequence
  source 1..14: mol_type = other DNA
ccttactccatttc

SEQ ID NO: 21 - DNA, 14 bp, synthetic construct
  misc_feature 1..14: note = motif sequence
  source 1..14: mol_type = other DNA
gccttactccattt

SEQ ID NO: 22 - DNA, 14 bp, synthetic construct
  misc_feature 1..14: note = motif sequence
  source 1..14: mol_type = other DNA
ggccttactccatt

SEQ ID NO: 23 - DNA, 14 bp, synthetic construct
  misc_feature 1..14: note = motif sequence
  source 1..14: mol_type = other DNA
gaaagaccaaagtg

SEQ ID NO: 24 - DNA, 14 bp, synthetic construct
  misc_feature 1..14: note = motif sequence
  source 1..14: mol_type = other DNA
aggaaagaccaaag

SEQ ID NO: 25 - DNA, 14 bp, synthetic construct
  misc_feature 1..14: note = motif sequence
  source 1..14: mol_type = other DNA
gaaggaaagaccaa

SEQ ID NO: 26 - DNA, 14 bp, synthetic construct
  misc_feature 1..14: note = motif sequence
  source 1..14: mol_type = other DNA
ggaaggaaagacca

SEQ ID NO: 27 - DNA, 14 bp, synthetic construct
  misc_feature 1..14: note = motif sequence
  source 1..14: mol_type = other DNA
tggaaggaaagacc

SEQ ID NO: 28 - DNA, 14 bp, synthetic construct
  misc_feature 1..14: note = motif sequence
  source 1..14: mol_type = other DNA
ctggaaggaaagac

SEQ ID NO: 29 - DNA, 14 bp, synthetic construct
  misc_feature 1..14: note = motif sequence
  source 1..14: mol_type = other DNA
cctggaaggaaaga

SEQ ID NO: 30 - DNA, 14 bp, synthetic construct
  misc_feature 1..14: note = motif sequence
  source 1..14: mol_type = other DNA
ccctggaaggaaag

SEQ ID NO: 31 - DNA, 14 bp, synthetic construct
  misc_feature 1..14: note = motif sequence
  source 1..14: mol_type = other DNA
tccctggaaggaaa

SEQ ID NO: 32 - DNA, 14 bp, synthetic construct
  misc_feature 1..14: note = motif sequence
  source 1..14: mol_type = other DNA
ttccctggaaggaa

SEQ ID NO: 33 - DNA, 14 bp, synthetic construct
  misc_feature 1..14: note = motif sequence
  source 1..14: mol_type = other DNA
tttccctggaagga

SEQ ID NO: 34 - DNA, 14 bp, synthetic construct
  misc_feature 1..14: note = motif sequence
  source 1..14: mol_type = other DNA
atttccctggaagg

SEQ ID NO: 35 - DNA, 14 bp, synthetic construct
  misc_feature 1..14: note = motif sequence
  source 1..14: mol_type = other DNA
catttccctggaag

SEQ ID NO: 36 - DNA, 14 bp, synthetic construct
  misc_feature 1..14: note = motif sequence
  source 1..14: mol_type = other DNA
ccatttccctggaa

SEQ ID NO: 37 - DNA, 14 bp, synthetic construct
  misc_feature 1..14: note = motif sequence
  source 1..14: mol_type = other DNA
tccatttccctgga

SEQ ID NO: 38 - DNA, 14 bp, synthetic construct
  misc_feature 1..14: note = motif sequence
  source 1..14: mol_type = other DNA
ctccatttccctgg

SEQ ID NO: 39 - DNA, 14 bp, synthetic construct
  misc_feature 1..14: note = motif sequence
  source 1..14: mol_type = other DNA
actccatttccctg

SEQ ID NO: 40 - DNA, 14 bp, synthetic construct
  misc_feature 1..14: note = motif sequence
  source 1..14: mol_type = other DNA
tactccatttccct

SEQ ID NO: 41 - DNA, 14 bp, synthetic construct
  misc_feature 1..14: note = motif sequence
  source 1..14: mol_type = other DNA
ttactccatttccc

SEQ ID NO: 42 - DNA, 14 bp, synthetic construct
  misc_feature 1..14: note = motif sequence
  source 1..14: mol_type = other DNA
cttactccatttcc

SEQ ID NO: 43 - DNA, 14 bp, synthetic construct
  misc_feature 1..14: note = motif sequence
  source 1..14: mol_type = other DNA
ccttactccatttc

SEQ ID NO: 44 - DNA, 14 bp, synthetic construct
  misc_feature 1..14: note = motif sequence
  source 1..14: mol_type = other DNA
gccttactccattt

SEQ ID NO: 45 - DNA, 14 bp, synthetic construct
  misc_feature 1..14: note = motif sequence
  source 1..14: mol_type = other DNA
ggccttactccatt

SEQ ID NO: 46 - DNA, 14 bp, synthetic construct
  misc_feature 1..14: note = motif sequence
  source 1..14: mol_type = other DNA
ccggccttactcca

SEQ ID NO: 47 - DNA, 14 bp, synthetic construct
  misc_feature 1..14: note = motif sequence
  source 1..14: mol_type = other DNA
caccggccttactc

SEQ ID NO: 48 - DNA, 18 bp, synthetic construct
  misc_feature 1..18: note = motif sequence
  source 1..18: mol_type = other DNA
ccactggaaattaagaaa

SEQ ID NO: 49 - DNA, 18 bp, synthetic construct
  misc_feature 1..18: note = motif sequence
  source 1..18: mol_type = other DNA
ctggaaattaagaaagtg

SEQ ID NO: 50 - DNA, 18 bp, synthetic construct
  misc_feature 1..18: note = motif sequence
  source 1..18: mol_type = other DNA
gaaattaagaaagtgact

SEQ ID NO: 51 - DNA, 18 bp, synthetic construct
  misc_feature 1..18: note = motif sequence
  source 1..18: mol_type = other DNA
attaagaaagtgactgct

SEQ ID NO: 52 - DNA, 18 bp, synthetic construct
  misc_feature 1..18: note = motif sequence
  source 1..18: mol_type = other DNA
aagaaagtgactgcttac

SEQ ID NO: 53 - DNA, 18 bp, synthetic construct
  misc_feature 1..18: note = motif sequence
  source 1..18: mol_type = other DNA
aaagtgactgcttacccc

SEQ ID NO: 54 - DNA, 18 bp, synthetic construct
  misc_feature 1..18: note = motif sequence
  source 1..18: mol_type = other DNA
gtgactgcttacccctaa

SEQ ID NO: 55 - DNA, 18 bp, synthetic construct
  misc_feature 1..18: note = motif sequence
  source 1..18: mol_type = other DNA
actgcttacccctaaccc

SEQ ID NO: 56 - DNA, 18 bp, synthetic construct
  misc_feature 1..18: note = motif sequence
  source 1..18: mol_type = other DNA
gcttacccctaaccctac

SEQ ID NO: 57 - DNA, 18 bp, synthetic construct
  misc_feature 1..18: note = motif sequence
  source 1..18: mol_type = other DNA
tacccctaaccctaccaa

SEQ ID NO: 58 - DNA, 18 bp, synthetic construct
  misc_feature 1..18: note = motif sequence
  source 1..18: mol_type = other DNA
ccctaaccctaccaatac

SEQ ID NO: 59 - DNA, 18 bp, synthetic construct
  misc_feature 1..18: note = motif sequence
  source 1..18: mol_type = other DNA
taaccctaccaatactaa

SEQ ID NO: 60 - DNA, 18 bp, synthetic construct
  misc_feature 1..18: note = motif sequence
  source 1..18: mol_type = other DNA
ccctaccaatactaactt

SEQ ID NO: 61 - DNA, 18 bp, synthetic construct
  misc_feature 1..18: note = motif sequence
  source 1..18: mol_type = other DNA
taccaatactaacttctt

SEQ ID NO: 62 - DNA, 18 bp, synthetic construct
  misc_feature 1..18: note = motif sequence
  source 1..18: mol_type = other DNA
caatactaacttctttct

SEQ ID NO: 63 - DNA, 18 bp, synthetic construct
  misc_feature 1..18: note = motif sequence
  source 1..18: mol_type = other DNA
tactaacttctttctcca

SEQ ID NO: 64 - DNA, 18 bp, synthetic construct
  misc_feature 1..18: note = motif sequence
  source 1..18: mol_type = other DNA
taacttctttctccattt

SEQ ID NO: 65 - DNA, 18 bp, synthetic construct
  misc_feature 1..18: note = motif sequence
  source 1..18: mol_type = other DNA
cttctttctccatttgcc

SEQ ID NO: 66 - DNA, 18 bp, synthetic construct
  misc_feature 1..18: note = motif sequence
  source 1..18: mol_type = other DNA
ctttctccatttgcctgg

SEQ ID NO: 67 - DNA, 18 bp, synthetic construct
  misc_feature 1..18: note = motif sequence
  source 1..18: mol_type = other DNA
tctccatttgcctggcta

SEQ ID NO: 68 - DNA, 18 bp, synthetic construct
  misc_feature 1..18: note = motif sequence
  source 1..18: mol_type = other DNA
ccatttgcctggctaggc

SEQ ID NO: 69 - DNA, 18 bp, synthetic construct
  misc_feature 1..18: note = motif sequence
  source 1..18: mol_type = other DNA
tttgcctggctaggcatg

SEQ ID NO: 70 - DNA, 18 bp, synthetic construct
  misc_feature 1..18: note = motif sequence
  source 1..18: mol_type = other DNA
gcctggctaggcatgtca

SEQ ID NO: 71 - DNA, 18 bp, synthetic construct
  misc_feature 1..18: note = motif sequence
  source 1..18: mol_type = other DNA
tggctaggcatgtcacac

SEQ ID NO: 72 - DNA, 18 bp, synthetic construct
  misc_feature 1..18: note = motif sequence
  source 1..18: mol_type = other DNA
ctaggcatgtcacacatc

SEQ ID NO: 73 - DNA, 18 bp, synthetic construct
  misc_feature 1..18: note = motif sequence
  source 1..18: mol_type = other DNA
ggcatgtcacacatcata

SEQ ID NO: 74 - DNA, 18 bp, synthetic construct
  misc_feature 1..18: note = motif sequence
  source 1..18: mol_type = other DNA
atgtcacacatcatatat

SEQ ID NO: 75 - DNA, 18 bp, synthetic construct
  misc_feature 1..18: note = motif sequence
  source 1..18: mol_type = other DNA
tcacacatcatatatata

SEQ ID NO: 76 - DNA, 18 bp, synthetic construct
  misc_feature 1..18: note = motif sequence
  source 1..18: mol_type = other DNA
cacatcatatatatacta

SEQ ID NO: 77 - DNA, 18 bp, synthetic construct
  misc_feature 1..18: note = motif sequence
  source 1..18: mol_type = other DNA
atcatatatatactacag

SEQ ID NO: 78 - DNA, 18 bp, synthetic construct
  misc_feature 1..18: note = motif sequence
  source 1..18: mol_type = other DNA
atatatatactacagaat

SEQ ID NO: 79 - DNA, 18 bp, synthetic construct
  misc_feature 1..18: note = motif sequence
  source 1..18: mol_type = other DNA
tatatactacagaatgag

SEQ ID NO: 80 - DNA, 18 bp, synthetic construct
  misc_feature 1..18: note = motif sequence
  source 1..18: mol_type = other DNA
atactacagaatgagcca

SEQ ID NO: 81 - DNA, 18 bp, synthetic construct
  misc_feature 1..18: note = motif sequence
  source 1..18: mol_type = other DNA
ctacagaatgagccaatc

SEQ ID NO: 82 - DNA, 18 bp, synthetic construct
  misc_feature 1..18: note = motif sequence
  source 1..18: mol_type = other DNA
cagaatgagccaatctta

SEQ ID NO: 83 - DNA, 18 bp, synthetic construct
  misc_feature 1..18: note = motif sequence
  source 1..18: mol_type = other DNA
aatgagccaatcttacac

SEQ ID NO: 84 - DNA, 18 bp, synthetic construct
  misc_feature 1..18: note = motif sequence
  source 1..18: mol_type = other DNA
gagccaatcttacacagt

SEQ ID NO: 85 - DNA, 18 bp, synthetic construct
  misc_feature 1..18: note = motif sequence
  source 1..18: mol_type = other DNA
ccaatcttacacagtgct

SEQ ID NO: 86 - DNA, 18 bp, synthetic construct
  misc_feature 1..18: note = motif sequence
  source 1..18: mol_type = other DNA
atcttacacagtgcttta

SEQ ID NO: 87 - DNA, 18 bp, synthetic construct
  misc_feature 1..18: note = motif sequence
  source 1..18: mol_type = other DNA
ttacacagtgctttagta

SEQ ID NO: 88 - DNA, 18 bp, synthetic construct
  misc_feature 1..18: note = motif sequence
  source 1..18: mol_type = other DNA
cacagtgctttagtaagg

SEQ ID NO: 89 - DNA, 18 bp, synthetic construct
  misc_feature 1..18: note = motif sequence
  source 1..18: mol_type = other DNA
agtgctttagtaaggcaa

SEQ ID NO: 90 - DNA, 18 bp, synthetic construct
  misc_feature 1..18: note = motif sequence
  source 1..18: mol_type = other DNA
gctttagtaaggcaaaca

SEQ ID NO: 91 - DNA, 18 bp, synthetic construct
  misc_feature 1..18: note = motif sequence
  source 1..18: mol_type = other DNA
ttagtaaggcaaacaagc

SEQ ID NO: 92 - DNA, 18 bp, synthetic construct
  misc_feature 1..18: note = motif sequence
  source 1..18: mol_type = other DNA
gtaaggcaaacaagctct

SEQ ID NO: 93 - DNA, 18 bp, synthetic construct
  misc_feature 1..18: note = motif sequence
  source 1..18: mol_type = other DNA
aggcaaacaagctctacc

SEQ ID NO: 94 - DNA, 18 bp, synthetic construct
  misc_feature 1..18: note = motif sequence
  source 1..18: mol_type = other DNA
caaacaagctctacctcg

SEQ ID NO: 95 - DNA, 18 bp, synthetic construct
  misc_feature 1..18: note = motif sequence
  source 1..18: mol_type = other DNA
acaagctctacctcggag

SEQ ID NO: 96 - DNA, 18 bp, synthetic construct
  misc_feature 1..18: note = motif sequence
  source 1..18: mol_type = other DNA
agctctacctcggagtct

SEQ ID NO: 97 - DNA, 18 bp, synthetic construct
  misc_feature 1..18: note = motif sequence
  source 1..18: mol_type = other DNA
tctacctcggagtctgaa

SEQ ID NO: 98 - DNA, 18 bp, synthetic construct
  misc_feature 1..18: note = motif sequence
  source 1..18: mol_type = other DNA
acctcggagtctgaagag

SEQ ID NO: 99 - DNA, 18 bp, synthetic construct
  misc_feature 1..18: note = motif sequence
  source 1..18: mol_type = other DNA
tcggagtctgaagagtca

SEQ ID NO: 100 - DNA, 18 bp, synthetic construct
  misc_feature 1..18: note = motif sequence
  source 1..18: mol_type = other DNA
gagtctgaagagtcaaca

SEQ ID NO: 101 - DNA, 18 bp, synthetic construct
  misc_feature 1..18: note = motif sequence
  source 1..18: mol_type = other DNA
tctgaagagtcaacagtg

SEQ ID NO: 102 - DNA, 18 bp, synthetic construct
  misc_feature 1..18: note = motif sequence
  source 1..18: mol_type = other DNA
gaagagtcaacagtgtca

SEQ ID NO: 103 - DNA, 18 bp, synthetic construct
  misc_feature 1..18: note = motif sequence
  source 1..18: mol_type = other DNA
gagtcaacagtgtcagaa

SEQ ID NO: 104 - DNA, 18 bp, synthetic construct
  misc_feature 1..18: note = motif sequence
  source 1..18: mol_type = other DNA
tcaacagtgtcagaatcc

SEQ ID NO: 105 - DNA, 18 bp, synthetic construct
  misc_feature 1..18: note = motif sequence
  source 1..18: mol_type = other DNA
acagtgtcagaatccatg

SEQ ID NO: 106 - DNA, 18 bp, synthetic construct
  misc_feature 1..18: note = motif sequence
  source 1..18: mol_type = other DNA
gtgtcagaatccatggga

SEQ ID NO: 107 - DNA, 18 bp, synthetic construct
  misc_feature 1..18: note = motif sequence
  source 1..18: mol_type = other DNA
tcagaatccatgggaaga

SEQ ID NO: 108 - DNA, 18 bp, synthetic construct
  misc_feature 1..18: note = motif sequence
  source 1..18: mol_type = other DNA
gaatccatgggaagatgt

SEQ ID NO: 109 - DNA, 18 bp, synthetic construct
  misc_feature 1..18: note = motif sequence
  source 1..18: mol_type = other DNA
tccatgggaagatgttct

SEQ ID NO: 110 - DNA, 18 bp, synthetic construct
  misc_feature 1..18: note = motif sequence
  source 1..18: mol_type = other DNA
atgggaagatgttctggg

SEQ ID NO: 111 - DNA, 18 bp, synthetic construct
  misc_feature 1..18: note = motif sequence
  source 1..18: mol_type = other DNA
ggaagatgttctggggag

SEQ ID NO: 112 - DNA, 18 bp, synthetic construct
  misc_feature 1..18: note = motif sequence
  source 1..18: mol_type = other DNA
agatgttctggggaggtg

SEQ ID NO: 113 - DNA, 18 bp, synthetic construct
  misc_feature 1..18: note = motif sequence
  source 1..18: mol_type = other DNA
tgttctggggaggtgaca

SEQ ID NO: 114 - DNA, 18 bp, synthetic construct
  misc_feature 1..18: note = motif sequence
  source 1..18: mol_type = other DNA
tctggggaggtgacaact

SEQ ID NO: 115 - DNA, 18 bp, synthetic construct
  misc_feature 1..18: note = motif sequence
  source 1..18: mol_type = other DNA
ggggaggtgacaactggg

SEQ ID NO: 116 - DNA, 18 bp, synthetic construct
  misc_feature 1..18: note = motif sequence
  source 1..18: mol_type = other DNA
gaggtgacaactgggcct

SEQ ID NO: 117 - DNA, 18 bp, synthetic construct
  misc_feature 1..18: note = motif sequence
  source 1..18: mol_type = other DNA
gtgacaactgggcctgca

SEQ ID NO: 118 - DNA, 18 bp, synthetic construct
  misc_feature 1..18: note = motif sequence
  source 1..18: mol_type = other DNA
acaactgggcctgcacct

SEQ ID NO: 119 - DNA, 18 bp, synthetic construct
  misc_feature 1..18: note = motif sequence
  source 1..18: mol_type = other DNA
actgggcctgcacctgct

SEQ ID NO: 120 - DNA, 18 bp, synthetic construct
  misc_feature 1..18: note = motif sequence
  source 1..18: mol_type = other DNA
gggcctgcacctgctgca

SEQ ID NO: 121 - DNA, 18 bp, synthetic construct
  misc_feature 1..18: note = motif sequence
  source 1..18: mol_type = other DNA
cctgcacctgctgcagag

SEQ ID NO: 122 - DNA, 18 bp, synthetic construct
  misc_feature 1..18: note = motif sequence
  source 1..18: mol_type = other DNA
gcacctgctgcagaggtg

SEQ ID NO: 123 - DNA, 18 bp, synthetic construct
  misc_feature 1..18: note = motif sequence
  source 1..18: mol_type = other DNA
cctgctgcagaggtgcac

SEQ ID NO: 124 - DNA, 18 bp, synthetic construct
  misc_feature 1..18: note = motif sequence
  source 1..18: mol_type = other DNA
gctgcagaggtgcacgta

SEQ ID NO: 125 - DNA, 18 bp, synthetic construct
  misc_feature 1..18: note = motif sequence
  source 1..18: mol_type = other DNA
gcagaggtgcacgtagtc

SEQ ID NO: 126 - DNA, 18 bp, synthetic construct
  misc_feature 1..18: note = motif sequence
  source 1..18: mol_type = other DNA
gaggtgcacgtagtctga

SEQ ID NO: 127 - DNA, 18 bp, synthetic construct
  misc_feature 1..18: note = motif sequence
  source 1..18: mol_type = other DNA
gtgcacgtagtctgagtg

SEQ ID NO: 128 - DNA, 18 bp, synthetic construct
  misc_feature 1..18: note = motif sequence
  source 1..18: mol_type = other DNA
cacgtagtctgagtgctg

SEQ ID NO: 129 - DNA, 18 bp, synthetic construct
  misc_feature 1..18: note = motif sequence
  source 1..18: mol_type = other DNA
gtagtctgagtgctgcgg

SEQ ID NO: 130 - DNA, 18 bp, synthetic construct
  misc_feature 1..18: note = motif sequence
  source 1..18: mol_type = other DNA
gtctgagtgctgcggact

SEQ ID NO: 131 - DNA, 18 bp, synthetic construct
  misc_feature 1..18: note = motif sequence
  source 1..18: mol_type = other DNA
tgagtgctgcggactcag

SEQ ID NO: 132 - DNA, 18 bp, synthetic construct
  misc_feature 1..18: note = motif sequence
  source 1..18: mol_type = other DNA
gtgctgcggactcagcag

SEQ ID NO: 133 - DNA, 18 bp, synthetic construct
  misc_feature 1..18: note = motif sequence
  source 1..18: mol_type = other DNA
ctgcggactcagcagacc

SEQ ID NO: 134 - DNA, 18 bp, synthetic construct
  misc_feature 1..18: note = motif sequence
  source 1..18: mol_type = other DNA
cggactcagcagacccgg

SEQ ID NO: 135 - DNA, 18 bp, synthetic construct
  misc_feature 1..18: note = motif sequence
  source 1..18: mol_type = other DNA
actcagcagacccggcca

SEQ ID NO: 136 - DNA, 18 bp, synthetic construct
  misc_feature 1..18: note = motif sequence
  source 1..18: mol_type = other DNA
cagcagacccggccaccg

SEQ ID NO: 137 - DNA, 18 bp, synthetic construct
  misc_feature 1..18: note = motif sequence
  source 1..18: mol_type = other DNA
cagacccggccaccggcc

SEQ ID NO: 138 - DNA, 18 bp, synthetic construct
  misc_feature 1..18: note = motif sequence
  source 1..18: mol_type = other DNA
acccggccaccggcctta

SEQ ID NO: 139 - DNA, 18 bp, synthetic construct
  misc_feature 1..18: note = motif sequence
  source 1..18: mol_type = other DNA
cggccaccggccttactc

SEQ ID NO: 140 - DNA, 18 bp, synthetic construct
  misc_feature 1..18: note = motif sequence
  source 1..18: mol_type = other DNA
ccaccggccttactccat

SEQ ID NO: 141 - DNA, 18 bp, synthetic construct
  misc_feature 1..18: note = motif sequence
  source 1..18: mol_type = other DNA
ccggccttactccatttc

SEQ ID NO: 142 - DNA, 18 bp, synthetic construct
  misc_feature 1..18: note = motif sequence
  source 1..18: mol_type = other DNA
gccttactccatttccct

SEQ ID NO: 143 - DNA, 18 bp, synthetic construct
  misc_feature 1..18: note = motif sequence
  source 1..18: mol_type = other DNA
ttactccatttccctgga

SEQ ID NO: 144 - DNA, 18 bp, synthetic construct
  misc_feature 1..18: note = motif sequence
  source 1..18: mol_type = other DNA
ctccatttccctggaagg

SEQ ID NO: 145 - DNA, 18 bp, synthetic construct
  misc_feature 1..18: note = motif sequence
  source 1..18: mol_type = other DNA
catttccctggaaggaaa

SEQ ID NO: 146 - DNA, 18 bp, synthetic construct
  misc_feature 1..18: note = motif sequence
  source 1..18: mol_type = other DNA
ttccctggaaggaaagac

SEQ ID NO: 147 - DNA, 18 bp, synthetic construct
  misc_feature 1..18: note = motif sequence
  source 1..18: mol_type = other DNA
cctggaaggaaagaccaa

SEQ ID NO: 148 - DNA, 18 bp, synthetic construct
  misc_feature 1..18: note = motif sequence
  source 1..18: mol_type = other DNA
ggaaggaaagaccaaagt

SEQ ID NO: 149 - DNA, 18 bp, synthetic construct
  misc_feature 1..18: note = motif sequence
  source 1..18: mol_type = other DNA
aggaaagaccaaagtgag

SEQ ID NO: 150 - DNA, 18 bp, synthetic construct
  misc_feature 1..18: note = motif sequence
  source 1..18: mol_type = other DNA
aaagaccaaagtgaggga

SEQ ID NO: 151 - DNA, 18 bp, synthetic construct
  misc_feature 1..18: note = motif sequence
  source 1..18: mol_type = other DNA
gaccaaagtgagggaaca

SEQ ID NO: 152 - DNA, 18 bp, synthetic construct
  misc_feature 1..18: note = motif sequence
  source 1..18: mol_type = other DNA
caaagtgagggaacactc

SEQ ID NO: 153 - DNA, 18 bp, synthetic construct
  misc_feature 1..18: note = motif sequence
  source 1..18: mol_type = other DNA
agtgagggaacactccaa

SEQ ID NO: 154 - DNA, 18 bp, synthetic construct
  misc_feature 1..18: note = motif sequence
  source 1..18: mol_type = other DNA
gagggaacactccaagga

SEQ ID NO: 155 - DNA, 18 bp, synthetic construct
  misc_feature 1..18: note = motif sequence
  source 1..18: mol_type = other DNA
ggaacactccaaggaaat

SEQ ID NO: 156 - DNA, 18 bp, synthetic construct
  misc_feature 1..18: note = motif sequence
  source 1..18: mol_type = other DNA
acactccaaggaaatgca

SEQ ID NO: 157 - DNA, 18 bp, synthetic construct
  misc_feature 1..18: note = motif sequence
  source 1..18: mol_type = other DNA
ctccaaggaaatgcacac

SEQ ID NO: 158 - DNA, 18 bp, synthetic construct
  misc_feature 1..18: note = motif sequence
  source 1..18: mol_type = other DNA
caaggaaatgcacaccag

SEQ ID NO: 159 - DNA, 18 bp, synthetic construct
  misc_feature 1..18: note = motif sequence
  source 1..18: mol_type = other DNA
ggaaatgcacaccaggct

SEQ ID NO: 160 - DNA, 18 bp, synthetic construct
  misc_feature 1..18: note = motif sequence
  source 1..18: mol_type = other DNA
aatgcacaccaggctatg

SEQ ID NO: 161 - DNA, 18 bp, synthetic construct
  misc_feature 1..18: note = motif sequence
  source 1..18: mol_type = other DNA
gcacaccaggctatggga

SEQ ID NO: 162 - DNA, 18 bp, synthetic construct
  misc_feature 1..18: note = motif sequence
  source 1..18: mol_type = other DNA
caccaggctatgggaggt

SEQ ID NO: 163 - DNA, 18 bp, synthetic construct
  misc_feature 1..18: note = motif sequence
  source 1..18: mol_type = other DNA
caggctatgggaggtggc

SEQ ID NO: 164 - DNA, 18 bp, synthetic construct
  misc_feature 1..18: note = motif sequence
  source 1..18: mol_type = other DNA
gctatgggaggtggctca

SEQ ID NO: 165 - DNA, 18 bp, synthetic construct
  misc_feature 1..18: note = motif sequence
  source 1..18: mol_type = other DNA
atgggaggtggctcagag

SEQ ID NO: 166 - DNA, 18 bp, synthetic construct
  misc_feature 1..18: note = motif sequence
  source 1..18: mol_type = other DNA
ggaggtggctcagagcat

SEQ ID NO: 167 - DNA, 18 bp, synthetic construct
  misc_feature 1..18: note = motif sequence
  source 1..18: mol_type = other DNA
ggtggctcagagcataag

SEQ ID NO: 168 - DNA, 18 bp, synthetic construct
  misc_feature 1..18: note = motif sequence
  source 1..18: mol_type = other DNA
ggctcagagcataagcct

SEQ ID NO: 169 - DNA, 18 bp, synthetic construct
  misc_feature 1..18: note = motif sequence
  source 1..18: mol_type = other DNA
tcagagcataagcctgct

SEQ ID NO: 170 - DNA, 18 bp, synthetic construct
  misc_feature 1..18: note = motif sequence
  source 1..18: mol_type = other DNA
gagcataagcctgcttgt

SEQ ID NO: 171 - DNA, 18 bp, synthetic construct
  misc_feature 1..18: note = motif sequence
  source 1..18: mol_type = other DNA
cataagcctgcttgttag

SEQ ID NO: 172 - DNA, 18 bp, synthetic construct
  misc_feature 1..18: note = motif sequence
  source 1..18: mol_type = other DNA
aagcctgcttgttaggca

SEQ ID NO: 173 - DNA, 18 bp, synthetic construct
  misc_feature 1..18: note = motif sequence
  source 1..18: mol_type = other DNA
cctgcttgttaggcaagc

SEQ ID NO: 174 - DNA, 18 bp, synthetic construct
  misc_feature 1..18: note = motif sequence
  source 1..18: mol_type = other DNA
gcttgttaggcaagcatc

SEQ ID NO: 175 - DNA, 18 bp, synthetic construct
  misc_feature 1..18: note = motif sequence
  source 1..18: mol_type = other DNA
tgttaggcaagcatcaat

SEQ ID NO: 176 - DNA, 18 bp, synthetic construct
  misc_feature 1..18: note = motif sequence
  source 1..18: mol_type = other DNA
taggcaagcatcaatgta

SEQ ID NO: 177 - DNA, 18 bp, synthetic construct
  misc_feature 1..18: note = motif sequence
  source 1..18: mol_type = other DNA
gcaagcatcaatgtaaaa

SEQ ID NO: 178 - DNA, 18 bp, synthetic construct
  misc_feature 1..18: note = motif sequence
  source 1..18: mol_type = other DNA
agcatcaatgtaaaattt

SEQ ID NO: 179 - DNA, 18 bp, synthetic construct
  misc_feature 1..18: note = motif sequence
  source 1..18: mol_type = other DNA
atcaatgtaaaatttgga

SEQ ID NO: 180 - DNA, 18 bp, synthetic construct
  misc_feature 1..18: note = motif sequence
  source 1..18: mol_type = other DNA
aatgtaaaatttggagca

SEQ ID NO: 181 - DNA, 18 bp, synthetic construct
  misc_feature 1..18: note = motif sequence
  source 1..18: mol_type = other DNA
gtaaaatttggagcatga

SEQ ID NO: 182 - DNA, 18 bp, synthetic construct
  misc_feature 1..18: note = motif sequence
  source 1..18: mol_type = other DNA
aaatttggagcatgacag

SEQ ID NO: 183 - DNA, 18 bp, synthetic construct
  misc_feature 1..18: note = motif sequence
  source 1..18: mol_type = other DNA
tttggagcatgacagttg

SEQ ID NO: 184 - DNA, 18 bp, synthetic construct
  misc_feature 1..18: note = motif sequence
  source 1..18: mol_type = other DNA
ggagcatgacagttgtgc

SEQ ID NO: 185 - DNA, 18 bp, synthetic construct
  misc_feature 1..18: note = motif sequence
  source 1..18: mol_type = other DNA
gcatgacagttgtgcctg

SEQ ID NO: 186 - DNA, 18 bp, synthetic construct
  misc_feature 1..18: note = motif sequence
  source 1..18: mol_type = other DNA
tgacagttgtgcctgtat

SEQ ID NO: 187 - DNA, 18 bp, synthetic construct
  misc_feature 1..18: note = motif sequence
  source 1..18: mol_type = other DNA
cagttgtgcctgtataac

SEQ ID NO: 188 - DNA, 18 bp, synthetic construct
  misc_feature 1..18: note = motif sequence
  source 1..18: mol_type = other DNA
ttgtgcctgtataacccc

SEQ ID NO: 189 - DNA, 18 bp, synthetic construct
  misc_feature 1..18: note = motif sequence
  source 1..18: mol_type = other DNA
tgcctgtataaccccaac

SEQ ID NO: 190 - DNA, 18 bp, synthetic construct
  misc_feature 1..18: note = motif sequence
  source 1..18: mol_type = other DNA
ctgtataaccccaacact

SEQ ID NO: 191 - DNA, 18 bp, synthetic construct
  misc_feature 1..18: note = motif sequence
  source 1..18: mol_type = other DNA
tataaccccaacactgag

SEQ ID NO: 192 - DNA, 18 bp, synthetic construct
  misc_feature 1..18: note = motif sequence
  source 1..18: mol_type = other DNA
aaccccaacactgaggga

SEQ ID NO: 193 - DNA, 18 bp, synthetic construct
  misc_feature 1..18: note = motif sequence
  source 1..18: mol_type = other DNA
caagctctacctcggagt

SEQ ID NO: 194 - DNA, 18 bp, synthetic construct
  misc_feature 1..18: note = motif sequence
  source 1..18: mol_type = other DNA
aagctctacctcggagtc

SEQ ID NO: 195 - DNA, 18 bp, synthetic construct
  misc_feature 1..18: note = motif sequence
  source 1..18: mol_type = other DNA
gctctacctcggagtctg

SEQ ID NO: 196 - DNA, 18 bp, synthetic construct
  misc_feature 1..18: note = motif sequence
  source 1..18: mol_type = other DNA
ctctacctcggagtctga

SEQ ID NO: 197 - DNA, 18 bp, synthetic construct
  misc_feature 1..18: note = motif sequence
  source 1..18: mol_type = other DNA
ctacctcggagtctgaag

SEQ ID NO: 198 - DNA, 18 bp, synthetic construct
  misc_feature 1..18: note = motif sequence
  source 1..18: mol_type = other DNA
tacctcggagtctgaaga

SEQ ID NO: 199 - DNA, 18 bp, synthetic construct
  misc_feature 1..18: note = motif sequence
  source 1..18: mol_type = other DNA
cctcggagtctgaagagt

SEQ ID NO: 200 - DNA, 18 bp, synthetic construct
  misc_feature 1..18: note = motif sequence
  source 1..18: mol_type = other DNA
ctcggagtctgaagagtc

SEQ ID NO: 201 - DNA, 18 bp, synthetic construct
  misc_feature 1..18: note = motif sequence
  source 1..18: mol_type = other DNA
cggagtctgaagagtcaa

SEQ ID NO: 202 - DNA, 18 bp, synthetic construct
  misc_feature 1..18: note = motif sequence
  source 1..18: mol_type = other DNA
ggagtctgaagagtcaac

SEQ ID NO: 203 - DNA, 18 bp, synthetic construct
  misc_feature 1..18: note = motif sequence
  source 1..18: mol_type = other DNA
agtctgaagagtcaacag

SEQ ID NO: 204 - DNA, 18 bp, synthetic construct
  misc_feature 1..18: note = motif sequence
  source 1..18: mol_type = other DNA
gtctgaagagtcaacagt

SEQ ID NO: 205 - DNA, 18 bp, synthetic construct
  misc_feature 1..18: note = motif sequence
  source 1..18: mol_type = other DNA
ctgaagagtcaacagtgt

SEQ ID NO: 206 - DNA, 18 bp, synthetic construct
  misc_feature 1..18: note = motif sequence
  source 1..18: mol_type = other DNA
tgaagagtcaacagtgtc

SEQ ID NO: 207 - DNA, 18 bp, synthetic construct
  misc_feature 1..18: note = motif sequence
  source 1..18: mol_type = other DNA
aagagtcaacagtgtcag

SEQ ID NO: 208 - DNA, 18 bp, synthetic construct
  misc_feature 1..18: note = motif sequence
  source 1..18: mol_type = other DNA
agagtcaacagtgtcaga

SEQ ID NO: 209 - DNA, 18 bp, synthetic construct
  misc_feature 1..18: note = motif sequence
  source 1..18: mol_type = other DNA
agtcaacagtgtcagaat

SEQ ID NO: 210 - DNA, 18 bp, synthetic construct
  misc_feature 1..18: note = motif sequence
  source 1..18: mol_type = other DNA
gtcaacagtgtcagaatc

SEQ ID NO: 211 - DNA, 18 bp, synthetic construct
  misc_feature 1..18: note = motif sequence
  source 1..18: mol_type = other DNA
caacagtgtcagaatcca

SEQ ID NO: 212 - DNA, 18 bp, synthetic construct
  misc_feature 1..18: note = motif sequence
  source 1..18: mol_type = other DNA
aacagtgtcagaatccat

SEQ ID NO: 213 - DNA, 18 bp, synthetic construct
  misc_feature 1..18: note = motif sequence
  source 1..18: mol_type = other DNA
cagtgtcagaatccatgg

SEQ ID NO: 214 - DNA, 18 bp, synthetic construct
  misc_feature 1..18: note = motif sequence
  source 1..18: mol_type = other DNA
agtgtcagaatccatggg

SEQ ID NO: 215 - DNA, 18 bp, synthetic construct
  misc_feature 1..18: note = motif sequence
  source 1..18: mol_type = other DNA
tgtcagaatccatgggaa

SEQ ID NO: 216 - DNA, 18 bp, synthetic construct
  misc_feature 1..18: note = motif sequence
  source 1..18: mol_type = other DNA
gtcagaatccatgggaag

SEQ ID NO: 217 - DNA, 18 bp, synthetic construct
  misc_feature 1..18: note = motif sequence
  source 1..18: mol_type = other DNA
cagaatccatgggaagat

SEQ ID NO: 218 - DNA, 18 bp, synthetic construct
  misc_feature 1..18: note = motif sequence
  source 1..18: mol_type = other DNA
agaatccatgggaagatg

SEQ ID NO: 219 - DNA, 18 bp, synthetic construct
  misc_feature 1..18: note = motif sequence
  source 1..18: mol_type = other DNA
aatccatgggaagatgtt

SEQ ID NO: 220 - DNA, 18 bp, synthetic construct
  misc_feature 1..18: note = motif sequence
  source 1..18: mol_type = other DNA
atccatgggaagatgttc

SEQ ID NO: 221 - DNA, 18 bp, synthetic construct
  misc_feature 1..18: note = motif sequence
  source 1..18: mol_type = other DNA
ccatgggaagatgttctg

SEQ ID NO: 222 - DNA, 18 bp, synthetic construct
  misc_feature 1..18: note = motif sequence
  source 1..18: mol_type = other DNA
catgggaagatgttctgg

SEQ ID NO: 223 - DNA, 18 bp, synthetic construct
  misc_feature 1..18: note = motif sequence
  source 1..18: mol_type = other DNA
tgggaagatgttctgggg

SEQ ID NO: 224 - DNA, 18 bp, synthetic construct
  misc_feature 1..18: note = motif sequence
  source 1..18: mol_type = other DNA
gggaagatgttctgggga

SEQ ID NO: 225 - DNA, 18 bp, synthetic construct
  misc_feature 1..18: note = motif sequence
  source 1..18: mol_type = other DNA
gaagatgttctggggagg

SEQ ID NO: 226 - DNA, 18 bp, synthetic construct
  misc_feature 1..18: note = motif sequence
  source 1..18: mol_type = other DNA
aagatgttctggggaggt

SEQ ID NO: 227 - DNA, 18 bp, synthetic construct
  misc_feature 1..18: note = motif sequence
  source 1..18: mol_type = other DNA
gatgttctggggaggtga

SEQ ID NO: 228 - DNA, 18 bp, synthetic construct
  misc_feature 1..18: note = motif sequence
  source 1..18: mol_type = other DNA
atgttctggggaggtgac

SEQ ID NO: 229 - DNA, 18 bp, synthetic construct
  misc_feature 1..18: note = motif sequence
  source 1..18: mol_type = other DNA
gttctggggaggtgacaa

SEQ ID NO: 230 - DNA, 18 bp, synthetic construct
  misc_feature 1..18: note = motif sequence
  source 1..18: mol_type = other DNA
ttctggggaggtgacaac

SEQ ID NO: 231 - DNA, 18 bp, synthetic construct
  misc_feature 1..18: note = motif sequence
  source 1..18: mol_type = other DNA
ctggggaggtgacaactg

SEQ ID NO: 232 - DNA, 18 bp, synthetic construct
  misc_feature 1..18: note = motif sequence
  source 1..18: mol_type = other DNA
tggggaggtgacaactgg

SEQ ID NO: 233 - DNA, 18 bp, synthetic construct
  misc_feature 1..18: note = motif sequence
  source 1..18: mol_type = other DNA
gggaggtgacaactgggc

SEQ ID NO: 234 - DNA, 18 bp, synthetic construct
  misc_feature 1..18: note = motif sequence
  source 1..18: mol_type = other DNA
ggaggtgacaactgggcc

SEQ ID NO: 235 - DNA, 18 bp, synthetic construct
  misc_feature 1..18: note = motif sequence
  source 1..18: mol_type = other DNA
aggtgacaactgggcctg

SEQ ID NO: 236 - DNA, 18 bp, synthetic construct
  misc_feature 1..18: note = motif sequence
  source 1..18: mol_type = other DNA
ggtgacaactgggcctgc

SEQ ID NO: 237 - DNA, 18 bp, synthetic construct
  misc_feature 1..18: note = motif sequence
  source 1..18: mol_type = other DNA
tgacaactgggcctgcac

SEQ ID NO: 238 - DNA, 18 bp, synthetic construct
  misc_feature 1..18: note = motif sequence
  source 1..18: mol_type = other DNA
gacaactgggcctgcacc

SEQ ID NO: 239 - DNA, 18 bp, synthetic construct
  misc_feature 1..18: note = motif sequence
  source 1..18: mol_type = other DNA
caactgggcctgcacctg

SEQ ID NO: 240 - DNA, 18 bp, synthetic construct
  misc_feature 1..18: note = motif sequence
  source 1..18: mol_type = other DNA
aactgggcctgcacctgc

SEQ ID NO: 241 - DNA, 18 bp, synthetic construct
  misc_feature 1..18: note = motif sequence
  source 1..18: mol_type = other DNA
ctgggcctgcacctgctg

SEQ ID NO: 242 - DNA, 18 bp, synthetic construct
  misc_feature 1..18: note = motif sequence
  source 1..18: mol_type = other DNA
tgggcctgcacctgctgc

SEQ ID NO: 243 - DNA, 18 bp, synthetic construct
  misc_feature 1..18: note = motif sequence
  source 1..18: mol_type = other DNA
ggcctgcacctgctgcag

SEQ ID NO: 244 - DNA, 18 bp, synthetic construct
  misc_feature 1..18: note = motif sequence
  source 1..18: mol_type = other DNA
gcctgcacctgctgcaga

SEQ ID NO: 245 - DNA, 18 bp, synthetic construct
  misc_feature 1..18: note = motif sequence
  source 1..18: mol_type = other DNA
ctgcacctgctgcagagg

SEQ ID NO: 246 - DNA, 18 bp, synthetic construct
  misc_feature 1..18: note = motif sequence
  source 1..18: mol_type = other DNA
tgcacctgctgcagaggt

SEQ ID NO: 247 - DNA, 18 bp, synthetic construct
  misc_feature 1..18: note = motif sequence
  source 1..18: mol_type = other DNA
cacctgctgcagaggtgc

SEQ ID NO: 248 - DNA, 18 bp, synthetic construct
  misc_feature 1..18: note = motif sequence
  source 1..18: mol_type = other DNA
acctgctgcagaggtgca

SEQ ID NO: 249 - DNA, 18 bp, synthetic construct
  misc_feature 1..18: note = motif sequence
  source 1..18: mol_type = other DNA
ctgctgcagaggtgcacg

SEQ ID NO: 250 - DNA, 18 bp, synthetic construct
  misc_feature 1..18: note = motif sequence
  source 1..18: mol_type = other DNA
tgctgcagaggtgcacgt

SEQ ID NO: 251 - DNA, 18 bp, synthetic construct
  misc_feature 1..18: note = motif sequence
  source 1..18: mol_type = other DNA
ctgcagaggtgcacgtag

SEQ ID NO: 252 - DNA, 18 bp, synthetic construct
  misc_feature 1..18: note = motif sequence
  source 1..18: mol_type = other DNA
tgcagaggtgcacgtagt

SEQ ID NO: 253 - DNA, 18 bp, synthetic construct
  misc_feature 1..18: note = motif sequence
  source 1..18: mol_type = other DNA
cagaggtgcacgtagtct

SEQ ID NO: 254 - DNA, 18 bp, synthetic construct
  misc_feature 1..18: note = motif sequence
  source 1..18: mol_type = other DNA
agaggtgcacgtagtctg

SEQ ID NO: 255 - DNA, 18 bp, synthetic construct
  misc_feature 1..18: note = motif sequence
  source 1..18: mol_type = other DNA
aggtgcacgtagtctgag

SEQ ID NO: 256 - DNA, 18 bp, synthetic construct
  misc_feature 1..18: note = motif sequence
  source 1..18: mol_type = other DNA
ggtgcacgtagtctgagt

SEQ ID NO: 257 - DNA, 18 bp, synthetic construct
  misc_feature 1..18: note = motif sequence
  source 1..18: mol_type = other DNA
tgcacgtagtctgagtgc

SEQ ID NO: 258 - DNA, 18 bp, synthetic construct
  misc_feature 1..18: note = motif sequence
  source 1..18: mol_type = other DNA
gcacgtagtctgagtgct

SEQ ID NO: 259 - DNA, 18 bp, synthetic construct
  misc_feature 1..18: note = motif sequence
  source 1..18: mol_type = other DNA
acgtagtctgagtgctgc

SEQ ID NO: 260 - DNA, 18 bp, synthetic construct
  misc_feature 1..18: note = motif sequence
  source 1..18: mol_type = other DNA
cgtagtctgagtgctgcg

SEQ ID NO: 261 - DNA, 18 bp, synthetic construct
  misc_feature 1..18: note = motif sequence
  source 1..18: mol_type = other DNA
tagtctgagtgctgcgga

SEQ ID NO: 262 - DNA, 18 bp, synthetic construct
  misc_feature 1..18: note = motif sequence
  source 1..18: mol_type = other DNA
agtctgagtgctgcggac

SEQ ID NO: 263 - DNA, 18 bp, synthetic construct
  misc_feature 1..18: note = motif sequence
  source 1..18: mol_type = other DNA
tctgagtgctgcggactc

SEQ ID NO: 264 - DNA, 18 bp, synthetic construct
  misc_feature 1..18: note = motif sequence
  source 1..18: mol_type = other DNA
ctgagtgctgcggactca

SEQ ID NO: 265 - DNA, 18 bp, synthetic construct
  misc_feature 1..18: note = motif sequence
  source 1..18: mol_type = other DNA
gagtgctgcggactcagc

SEQ ID NO: 266 - DNA, 18 bp, synthetic construct
  misc_feature 1..18: note = motif sequence
  source 1..18: mol_type = other DNA
agtgctgcggactcagca

SEQ ID NO: 267 - DNA, 18 bp, synthetic construct
  misc_feature 1..18: note = motif sequence
  source 1..18: mol_type = other DNA
tgctgcggactcagcaga

SEQ ID NO: 268 - DNA, 18 bp, synthetic construct
  misc_feature 1..18: note = motif sequence
  source 1..18: mol_type = other DNA
gctgcggactcagcagac

SEQ ID NO: 269 - DNA, 18 bp, synthetic construct
  misc_feature 1..18: note = motif sequence
  source 1..18: mol_type = other DNA
tgcggactcagcagaccc

SEQ ID NO: 270 - DNA, 18 bp, synthetic construct
  misc_feature 1..18: note = motif sequence
  source 1..18: mol_type = other DNA
gcggactcagcagacccg

SEQ ID NO: 271 - DNA, 18 bp, synthetic construct
  misc_feature 1..18: note = motif sequence
  source 1..18: mol_type = other DNA
ggactcagcagacccggc

SEQ ID NO: 272 - DNA, 18 bp, synthetic construct
  misc_feature 1..18: note = motif sequence
  source 1..18: mol_type = other DNA
gactcagcagacccggcc

SEQ ID NO: 273 - DNA, 18 bp, synthetic construct
  misc_feature 1..18: note = motif sequence
  source 1..18: mol_type = other DNA
ctcagcagacccggccac

SEQ ID NO: 274 - DNA, 18 bp, synthetic construct
  misc_feature 1..18: note = motif sequence
  source 1..18: mol_type = other DNA
tcagcagacccggccacc

SEQ ID NO: 275 - DNA, 18 bp, synthetic construct
  misc_feature 1..18: note = motif sequence
  source 1..18: mol_type = other DNA
agcagacccggccaccgg

SEQ ID NO: 276 - DNA, 18 bp, synthetic construct
  misc_feature 1..18: note = motif sequence
  source 1..18: mol_type = other DNA
gcagacccggccaccggc

SEQ ID NO: 277 - DNA, 18 bp, synthetic construct
  misc_feature 1..18: note = motif sequence
  source 1..18: mol_type = other DNA
agacccggccaccggcct

SEQ ID NO: 278 - DNA, 18 bp, synthetic construct
  misc_feature 1..18: note = motif sequence
  source 1..18: mol_type = other DNA
gacccggccaccggcctt

SEQ ID NO: 279 - DNA, 18 bp, synthetic construct
  misc_feature 1..18: note = motif sequence
  source 1..18: mol_type = other DNA
cccggccaccggccttac

SEQ ID NO: 280 - DNA, 18 bp, synthetic construct
  misc_feature 1..18: note = motif sequence
  source 1..18: mol_type = other DNA
ccggccaccggccttact

SEQ ID NO: 281 - DNA, 18 bp, synthetic construct
  misc_feature 1..18: note = motif sequence
  source 1..18: mol_type = other DNA
ggccaccggccttactcc

SEQ ID NO: 282 - DNA, 18 bp, synthetic construct
  misc_feature 1..18: note = motif sequence
  source 1..18: mol_type = other DNA
gccaccggccttactcca

SEQ ID NO: 283 - DNA, 18 bp, synthetic construct
  misc_feature 1..18: note = motif sequence
  source 1..18: mol_type = other DNA
caccggccttactccatt

SEQ ID NO: 284 - DNA, 18 bp, synthetic construct
  misc_feature 1..18: note = motif sequence
  source 1..18: mol_type = other DNA
accggccttactccattt

SEQ ID NO: 285 - DNA, 18 bp, synthetic construct
  misc_feature 1..18: note = motif sequence
  source 1..18: mol_type = other DNA
cggccttactccatttcc

SEQ ID NO: 286 - DNA, 18 bp, synthetic construct
  misc_feature 1..18: note = motif sequence
  source 1..18: mol_type = other DNA
ggccttactccatttccc

SEQ ID NO: 287 - DNA, 18 bp, synthetic construct
  misc_feature 1..18: note = motif sequence
  source 1..18: mol_type = other DNA
ccttactccatttccctg

SEQ ID NO: 288 - DNA, 18 bp, synthetic construct
  misc_feature 1..18: note = motif sequence
  source 1..18: mol_type = other DNA
cttactccatttccctgg

SEQ ID NO: 289 - DNA, 18 bp, synthetic construct
  misc_feature 1..18: note = motif sequence
  source 1..18: mol_type = other DNA
tactccatttccctggaa

SEQ ID NO: 290 - DNA, 18 bp, synthetic construct
  misc_feature 1..18: note = motif sequence
  source 1..18: mol_type = other DNA
actccatttccctggaag

SEQ ID NO: 291 - DNA, 18 bp, synthetic construct
  misc_feature 1..18: note = motif sequence
  source 1..18: mol_type = other DNA
tccatttccctggaagga

SEQ ID NO: 292 - DNA, 18 bp, synthetic construct
  misc_feature 1..18: note = motif sequence
  source 1..18: mol_type = other DNA
ccatttccctggaaggaa

SEQ ID NO: 293 - DNA, 18 bp, synthetic construct
  misc_feature 1..18: note = motif sequence
  source 1..18: mol_type = other DNA
atttccctggaaggaaag

SEQ ID NO: 294 - DNA, 18 bp, synthetic construct
  misc_feature 1..18: note = motif sequence
  source 1..18: mol_type = other DNA
tttccctggaaggaaaga

SEQ ID NO: 295 - DNA, 18 bp, synthetic construct
  misc_feature 1..18: note = motif sequence
  source 1..18: mol_type = other DNA
tccctggaaggaaagacc

SEQ ID NO: 296 - DNA, 18 bp, synthetic construct
  misc_feature 1..18: note = motif sequence
  source 1..18: mol_type = other DNA
ccctggaaggaaagacca

SEQ ID NO: 297 - DNA, 18 bp, synthetic construct
  misc_feature 1..18: note = motif sequence
  source 1..18: mol_type = other DNA
ctggaaggaaagaccaaa

SEQ ID NO: 298 - DNA, 18 bp, synthetic construct
  misc_feature 1..18: note = motif sequence
  source 1..18: mol_type = other DNA
tggaaggaaagaccaaag

SEQ ID NO: 299 - DNA, 14 bp, synthetic construct
  misc_feature 1..14: note = target site sequence
  source 1..14: mol_type = other DNA
ctttccttccaggg

SEQ ID NO: 300 - DNA, 14 bp, synthetic construct
  misc_feature 1..14: note = target site sequence
  source 1..14: mol_type = other DNA
ttccttccagggaa

SEQ ID NO: 301 - DNA, 14 bp, synthetic construct
  misc_feature 1..14: note = target site sequence
  source 1..14: mol_type = other DNA
tccttccagggaaa

SEQ ID NO: 302 - DNA, 14 bp, synthetic construct
  misc_feature 1..14: note = target site sequence
  source 1..14: mol_type = other DNA
ccttccagggaaat

SEQ ID NO: 303 - DNA, 14 bp, synthetic construct
  misc_feature 1..14: note = target site sequence
  source 1..14: mol_type = other DNA
cttccagggaaatg

SEQ ID NO: 304 - DNA, 14 bp, synthetic construct
  misc_feature 1..14: note = target site sequence
  source 1..14: mol_type = other DNA
ttccagggaaatgg

SEQ ID NO: 305 - DNA, 14 bp, synthetic construct
  misc_feature 1..14: note = target site sequence
  source 1..14: mol_type = other DNA
tccagggaaatgga

SEQ ID NO: 306 - DNA, 14 bp, synthetic construct
  misc_feature 1..14: note = target site sequence
  source 1..14: mol_type = other DNA
ccagggaaatggag

SEQ ID NO: 307 - DNA, 14 bp, synthetic construct
  misc_feature 1..14: note = target site sequence
  source 1..14: mol_type = other DNA
cagggaaatggagt

SEQ ID NO: 308 - DNA, 14 bp, synthetic construct
  misc_feature 1..14: note = target site sequence
  source 1..14: mol_type = other DNA
agggaaatggagta

SEQ ID NO: 309 - DNA, 14 bp, synthetic construct
  misc_feature 1..14: note = target site sequence
  source 1..14: mol_type = other DNA
gggaaatggagtaa

SEQ ID NO: 310 - DNA, 14 bp, synthetic construct
  misc_feature 1..14: note = target site sequence
  source 1..14: mol_type = other DNA
ggaaatggagtaag

SEQ ID NO: 311 - DNA, 14 bp, synthetic construct
  misc_feature 1..14: note = target site sequence
  source 1..14: mol_type = other DNA
gaaatggagtaagg

SEQ ID NO: 312 - DNA, 14 bp, synthetic construct
  misc_feature 1..14: note = target site sequence
  source 1..14: mol_type = other DNA
aaatggagtaaggc

SEQ ID NO: 313 - DNA, 14 bp, synthetic construct
  misc_feature 1..14: note = target site sequence
  source 1..14: mol_type = other DNA
aatggagtaaggcc

SEQ ID NO: 314 - DNA, 14 bp, synthetic construct
  misc_feature 1..14: note = target site sequence
  source 1..14: mol_type = other DNA
cactttggtctttc

SEQ ID NO: 315 - DNA, 14 bp, synthetic construct
  misc_feature 1..14: note = target site sequence
  source 1..14: mol_type = other DNA
ctttggtctttcct

SEQ ID NO: 316 - DNA, 14 bp, synthetic construct
  misc_feature 1..14: note = target site sequence
  source 1..14: mol_type = other DNA
ttggtctttccttc

SEQ ID NO: 317 - DNA, 14 bp, synthetic construct
  misc_feature 1..14: note = target site sequence
  source 1..14: mol_type = other DNA
tggtctttccttcc

SEQ ID NO: 318 - DNA, 14 bp, synthetic construct
  misc_feature 1..14: note = target site sequence
  source 1..14: mol_type = other DNA
ggtctttccttcca

SEQ ID NO: 319 - DNA, 14 bp, synthetic construct
  misc_feature 1..14: note = target site sequence
  source 1..14: mol_type = other DNA
gtctttccttccag

SEQ ID NO: 320 - DNA, 14 bp, synthetic construct
  misc_feature 1..14: note = target site sequence
  source 1..14: mol_type = other DNA
tctttccttccagg

SEQ ID NO: 321 - DNA, 14 bp, synthetic construct
  misc_feature 1..14: note = target site sequence
  source 1..14: mol_type = other DNA
ctttccttccaggg

SEQ ID NO: 322 - DNA, 14 bp, synthetic construct
  misc_feature 1..14: note = target site sequence
  source 1..14: mol_type = other DNA
tttccttccaggga

SEQ ID NO: 323 - DNA, 14 bp, synthetic construct
  misc_feature 1..14: note = target site sequence
  source 1..14: mol_type = other DNA
ttccttccagggaa

SEQ ID NO: 324 - DNA, 14 bp, synthetic construct
  misc_feature 1..14: note = target site sequence
  source 1..14: mol_type = other DNA
tccttccagggaaa

SEQ ID NO: 325 - DNA, 14 bp, synthetic construct
  misc_feature 1..14: note = target site sequence
  source 1..14: mol_type = other DNA
ccttccagggaaat

SEQ ID NO: 326 - DNA, 14 bp, synthetic construct
  misc_feature 1..14: note = target site sequence
  source 1..14: mol_type = other DNA
cttccagggaaatg

SEQ ID NO: 327 - DNA, 14 bp, synthetic construct
  misc_feature 1..14: note = target site sequence
  source 1..14: mol_type = other DNA
ttccagggaaatgg

SEQ ID NO: 328 - DNA, 14 bp, synthetic construct
  misc_feature 1..14: note = target site sequence
  source 1..14: mol_type = other DNA
tccagggaaatgga

SEQ ID NO: 329 - DNA, 14 bp, synthetic construct
  misc_feature 1..14: note = target site sequence
  source 1..14: mol_type = other DNA
ccagggaaatggag

SEQ ID NO: 330 - DNA, 14 bp, synthetic construct
  misc_feature 1..14: note = target site sequence
  source 1..14: mol_type = other DNA
cagggaaatggagt

SEQ ID NO: 331 - DNA, 14 bp, synthetic construct
  misc_feature 1..14: note = target site sequence
  source 1..14: mol_type = other DNA
agggaaatggagta

SEQ ID NO: 332 - DNA, 14 bp, synthetic construct
  misc_feature 1..14: note = target site sequence
  source 1..14: mol_type = other DNA
gggaaatggagtaa

SEQ ID NO: 333 - DNA, 14 bp, synthetic construct
  misc_feature 1..14: note = target site sequence
  source 1..14: mol_type = other DNA
ggaaatggagtaag

SEQ ID NO: 334 - DNA, 14 bp, synthetic construct
  misc_feature 1..14: note = target site sequence
  source 1..14: mol_type = other DNA
gaaatggagtaagg

SEQ ID NO: 335 - DNA, 14 bp, synthetic construct
  misc_feature 1..14: note = target site sequence
  source 1..14: mol_type = other DNA
aaatggagtaaggc

SEQ ID NO: 336 - DNA, 14 bp, synthetic construct
  misc_feature 1..14: note = target site sequence
  source 1..14: mol_type = other DNA
aatggagtaaggcc

SEQ ID NO: 337 - DNA, 14 bp, synthetic construct
  misc_feature 1..14: note = target site sequence
  source 1..14: mol_type = other DNA
tggagtaaggccgg

SEQ ID NO: 338 - DNA, 14 bp, synthetic construct
  misc_feature 1..14: note = target site sequence
  source 1..14: mol_type = other DNA
gagtaaggccggtg

SEQ ID NO: 339 - DNA, 18 bp, synthetic construct
  misc_feature 1..18: note = target site sequence
  source 1..18: mol_type = other DNA
tttcttaatttccagtgg

SEQ ID NO: 340 - DNA, 18 bp, synthetic construct
  misc_feature 1..18: note = target site sequence
  source 1..18: mol_type = other DNA
cactttcttaatttccag

SEQ ID NO: 341 - DNA, 18 bp, synthetic construct
  misc_feature 1..18: note = target site sequence
  source 1..18: mol_type = other DNA
agtcactttcttaatttc

SEQ ID NO: 342 - DNA, 18 bp, synthetic construct
  misc_feature 1..18: note = target site sequence
  source 1..18: mol_type = other DNA
agcagtcactttcttaat

SEQ ID NO: 343 - DNA, 18 bp, synthetic construct
  misc_feature 1..18: note = target site sequence
  source 1..18: mol_type = other DNA
gtaagcagtcactttctt

SEQ ID NO: 344 - DNA, 18 bp, synthetic construct
  misc_feature 1..18: note = target site sequence
  source 1..18: mol_type = other DNA
ggggtaagcagtcacttt

SEQ ID NO: 345 - DNA, 18 bp, synthetic construct
  misc_feature 1..18: note = target site sequence
  source 1..18: mol_type = other DNA
ttaggggtaagcagtcac

SEQ ID NO: 346 - DNA, 18 bp, synthetic construct
  misc_feature 1..18: note = target site sequence
  source 1..18: mol_type = other DNA
gggttaggggtaagcagt

SEQ ID NO: 347 - DNA, 18 bp, synthetic construct
  misc_feature 1..18: note = target site sequence
  source 1..18: mol_type = other DNA
gtagggttaggggtaagc

SEQ ID NO: 348 - DNA, 18 bp, synthetic construct
  misc_feature 1..18: note = target site sequence
  source 1..18: mol_type = other DNA
ttggtagggttaggggta

SEQ ID NO: 349 - DNA, 18 bp, synthetic construct
  misc_feature 1..18: note = target site sequence
  source 1..18: mol_type = other DNA
gtattggtagggttaggg

SEQ ID NO: 350 - DNA, 18 bp, synthetic construct
  misc_feature 1..18: note = target site sequence
  source 1..18: mol_type = other DNA
ttagtattggtagggtta

SEQ ID NO: 351 - DNA, 18 bp, synthetic construct
  misc_feature 1..18: note = target site sequence
  source 1..18: mol_type = other DNA
aagttagtattggtaggg

SEQ ID NO: 352 - DNA, 18 bp, synthetic construct
  misc_feature 1..18: note = target site sequence
  source 1..18: mol_type = other DNA
aagaagttagtattggta

SEQ ID NO: 353 - DNA, 18 bp, synthetic construct
  misc_feature 1..18: note = target site sequence
  source 1..18: mol_type = other DNA
agaaagaagttagtattg

SEQ ID NO: 354 - DNA, 18 bp, synthetic construct
  misc_feature 1..18: note = target site sequence
  source 1..18: mol_type = other DNA
tggagaaagaagttagta

SEQ ID NO: 355 - DNA, 18 bp, synthetic construct
  misc_feature 1..18: note = target site sequence
  source 1..18: mol_type = other DNA
aaatggagaaagaagtta

SEQ ID NO: 356 - DNA, 18 bp, synthetic construct
  misc_feature 1..18: note = target site sequence
  source 1..18: mol_type = other DNA
ggcaaatggagaaagaag

SEQ ID NO: 357 - DNA, 18 bp, synthetic construct
  misc_feature 1..18: note = target site sequence
  source 1..18: mol_type = other DNA
ccaggcaaatggagaaag

SEQ ID NO: 358 - DNA, 18 bp, synthetic construct
  misc_feature 1..18: note = target site sequence
  source 1..18: mol_type = other DNA
tagccaggcaaatggaga

SEQ ID NO: 359 - DNA, 18 bp, synthetic construct
  misc_feature 1..18: note = target site sequence
  source 1..18: mol_type = other DNA
gcctagccaggcaaatgg

SEQ ID NO: 360 - DNA, 18 bp, synthetic construct
  misc_feature 1..18: note = target site sequence
  source 1..18: mol_type = other DNA
catgcctagccaggcaaa

SEQ ID NO: 361 - DNA, 18 bp, synthetic construct
  misc_feature 1..18: note = target site sequence
  source 1..18: mol_type = other DNA
tgacatgcctagccaggc

SEQ ID NO: 362 - DNA, 18 bp, synthetic construct
  misc_feature 1..18: note = target site sequence
  source 1..18: mol_type = other DNA
gtgtgacatgcctagcca

SEQ ID NO: 363 - DNA, 18 bp, synthetic construct
  misc_feature 1..18: note = target site sequence
  source 1..18: mol_type = other DNA
gatgtgtgacatgcctag

SEQ ID NO: 364 - DNA, 18 bp, synthetic construct
  misc_feature 1..18: note = target site sequence
  source 1..18: mol_type = other DNA
tatgatgtgtgacatgcc

SEQ ID NO: 365 - DNA, 18 bp, synthetic construct
  misc_feature 1..18: note = target site sequence
  source 1..18: mol_type = other DNA
atatatgatgtgtgacat

SEQ ID NO: 366 - DNA, 18 bp, synthetic construct
  misc_feature 1..18: note = target site sequence
  source 1..18: mol_type = other DNA
tatatatatgatgtgtga

SEQ ID NO: 367 - DNA, 18 bp, synthetic construct
  misc_feature 1..18: note = target site sequence
  source 1..18: mol_type = other DNA
tagtatatatatgatgtg

SEQ ID NO: 368 - DNA, 18 bp, synthetic construct
  misc_feature 1..18: note = target site sequence
  source 1..18: mol_type = other DNA
ctgtagtatatatatgat

SEQ ID NO: 369 - DNA, 18 bp, synthetic construct
  misc_feature 1..18: note = target site sequence
  source 1..18: mol_type = other DNA
attctgtagtatatatat

SEQ ID NO: 370 - DNA, 18 bp, synthetic construct
  misc_feature 1..18: note = target site sequence
  source 1..18: mol_type = other DNA
ctcattctgtagtatata

SEQ ID NO: 371 - DNA, 18 bp, synthetic construct
  misc_feature 1..18: note = target site sequence
  source 1..18: mol_type = other DNA
tggctcattctgtagtat

SEQ ID NO: 372 - DNA, 18 bp, synthetic construct
  misc_feature 1..18: note = target site sequence
  source 1..18: mol_type = other DNA
gattggctcattctgtag

SEQ ID NO: 373 - DNA, 18 bp, synthetic construct
  misc_feature 1..18: note = target site sequence
  source 1..18: mol_type = other DNA
taagattggctcattctg

SEQ ID NO: 374 - DNA, 18 bp, synthetic construct
  misc_feature 1..18: note = target site sequence
  source 1..18: mol_type = other DNA
gtgtaagattggctcatt

SEQ ID NO: 375 - DNA, 18 bp, synthetic construct
  misc_feature 1..18: note = target site sequence
  source 1..18: mol_type = other DNA
actgtgtaagattggctc

SEQ ID NO: 376 - DNA, 18 bp, synthetic construct
  misc_feature 1..18: note = target site sequence
  source 1..18: mol_type = other DNA
agcactgtgtaagattgg

SEQ ID NO: 377 - DNA, 18 bp, synthetic construct
  misc_feature 1..18: note = target site sequence
  source 1..18: mol_type = other DNA
taaagcactgtgtaagat

SEQ ID NO: 378 - DNA, 18 bp, synthetic construct
  misc_feature 1..18: note = target site sequence
  source 1..18: mol_type = other DNA
tactaaagcactgtgtaa

SEQ ID NO: 379 - DNA, 18 bp, synthetic construct
  misc_feature 1..18: note = target site sequence
  source 1..18: mol_type = other DNA
ccttactaaagcactgtg

SEQ ID NO: 380 - DNA, 18 bp, synthetic construct
  misc_feature 1..18: note = target site sequence
  source 1..18: mol_type = other DNA
ttgccttactaaagcact

SEQ ID NO: 381 - DNA, 18 bp, synthetic construct
  misc_feature 1..18: note = target site sequence
  source 1..18: mol_type = other DNA
tgtttgccttactaaagc

SEQ ID NO: 382 - DNA, 18 bp, synthetic construct
  misc_feature 1..18: note = target site sequence
  source 1..18: mol_type = other DNA
gcttgtttgccttactaa

SEQ ID NO: 383 - DNA, 18 bp, synthetic construct
  misc_feature 1..18: note = target site sequence
  source 1..18: mol_type = other DNA
agagcttgtttgccttac

SEQ ID NO: 384 - DNA, 18 bp, synthetic construct
  misc_feature 1..18: note = target site sequence
  source 1..18: mol_type = other DNA
ggtagagcttgtttgcct

SEQ ID NO: 385 - DNA, 18 bp, synthetic construct
  misc_feature 1..18: note = target site sequence
  source 1..18: mol_type = other DNA
cgaggtagagcttgtttg

SEQ ID NO: 386 - DNA, 18 bp, synthetic construct
  misc_feature 1..18: note = target site sequence
  source 1..18: mol_type = other DNA
ctccgaggtagagcttgt

SEQ ID NO: 387 - DNA, 18 bp, synthetic construct
  misc_feature 1..18: note = target site sequence
  source 1..18: mol_type = other DNA
agactccgaggtagagct

SEQ ID NO: 388 - DNA, 18 bp, synthetic construct
  misc_feature 1..18: note = target site sequence
  source 1..18: mol_type = other DNA
ttcagactccgaggtaga

SEQ ID NO: 389 - DNA, 18 bp, synthetic construct
  misc_feature 1..18: note = target site sequence
  source 1..18: mol_type = other DNA
ctcttcagactccgaggt

SEQ ID NO: 390 - DNA, 18 bp, synthetic construct
  misc_feature 1..18: note = target site sequence
  source 1..18: mol_type = other DNA
tgactcttcagactccga

SEQ ID NO: 391 - DNA, 18 bp, synthetic construct
  misc_feature 1..18: note = target site sequence
  source 1..18: mol_type = other DNA
tgttgactcttcagactc

SEQ ID NO: 392 - DNA, 18 bp, synthetic construct
  misc_feature 1..18: note = target site sequence
  source 1..18: mol_type = other DNA
cactgttgactcttcaga

SEQ ID NO: 393 - DNA, 18 bp, synthetic construct
  misc_feature 1..18: note = target site sequence
  source 1..18: mol_type = other DNA
tgacactgttgactcttc

SEQ ID NO: 394 - DNA, 18 bp, synthetic construct
  misc_feature 1..18: note = target site sequence
  source 1..18: mol_type = other DNA
ttctgacactgttgactc

SEQ ID NO: 395 - DNA, 18 bp, synthetic construct
  misc_feature 1..18: note = target site sequence
  source 1..18: mol_type = other DNA
ggattctgacactgttga

SEQ ID NO: 396 - DNA, 18 bp, synthetic construct
  misc_feature 1..18: note = target site sequence
  source 1..18: mol_type = other DNA
catggattctgacactgt

SEQ ID NO: 397 - DNA, 18 bp, synthetic construct
  misc_feature 1..18: note = target site sequence
  source 1..18: mol_type = other DNA
tcccatggattctgacac

SEQ ID NO: 398 - DNA, 18 bp, synthetic construct
  misc_feature 1..18: note = target site sequence
  source 1..18: mol_type = other DNA
tcttcccatggattctga

SEQ ID NO: 399 - DNA, 18 bp, synthetic construct
  misc_feature 1..18: note = target site sequence
  source 1..18: mol_type = other DNA
acatcttcccatggattc

SEQ ID NO: 400 - DNA, 18 bp, synthetic construct
  misc_feature 1..18: note = target site sequence
  source 1..18: mol_type = other DNA
agaacatcttcccatgga

SEQ ID NO: 401 - DNA, 18 bp, synthetic construct
  misc_feature 1..18: note = target site sequence
  source 1..18: mol_type = other DNA
cccagaacatcttcccat

SEQ ID NO: 402 - DNA, 18 bp, synthetic construct
  misc_feature 1..18: note = target site sequence
  source 1..18: mol_type = other DNA
ctccccagaacatcttcc

SEQ ID NO: 403 - DNA, 18 bp, synthetic construct
  misc_feature 1..18: note = target site sequence
  source 1..18: mol_type = other DNA
cacctccccagaacatct

SEQ ID NO: 404 - DNA, 18 bp, synthetic construct
  misc_feature 1..18: note = target site sequence
  source 1..18: mol_type = other DNA
tgtcacctccccagaaca

SEQ ID NO: 405 - DNA, 18 bp, synthetic construct
  misc_feature 1..18: note = target site sequence
  source 1..18: mol_type = other DNA
agttgtcacctccccaga

SEQ ID NO: 406 - DNA, 18 bp, synthetic construct
  misc_feature 1..18: note = target site sequence
  source 1..18: mol_type = other DNA
cccagttgtcacctcccc

SEQ ID NO: 407 - DNA, 18 bp, synthetic construct
  misc_feature 1..18: note = target site sequence
  source 1..18: mol_type = other DNA
aggcccagttgtcacctc

SEQ ID NO: 408 - DNA, 18 bp, synthetic construct
  misc_feature 1..18: note = target site sequence
  source 1..18: mol_type = other DNA
tgcaggcccagttgtcac

SEQ ID NO: 409 - DNA, 18 bp, synthetic construct
  misc_feature 1..18: note = target site sequence
  source 1..18: mol_type = other DNA
aggtgcaggcccagttgt

SEQ ID NO: 410 - DNA, 18 bp, synthetic construct
  misc_feature 1..18: note = target site sequence
  source 1..18: mol_type = other DNA
agcaggtgcaggcccagt

SEQ ID NO: 411 - DNA, 18 bp, synthetic construct
  misc_feature 1..18: note = target site sequence
  source 1..18: mol_type = other DNA
tgcagcaggtgcaggccc

SEQ ID NO: 412 - DNA, 18 bp, synthetic construct
  misc_feature 1..18: note = target site sequence
  source 1..18: mol_type = other DNA
ctctgcagcaggtgcagg

SEQ ID NO: 413 - DNA, 18 bp, synthetic construct
  misc_feature 1..18: note = target site sequence
  source 1..18: mol_type = other DNA
cacctctgcagcaggtgc

SEQ ID NO: 414 - DNA, 18 bp, synthetic construct
  misc_feature 1..18: note = target site sequence
  source 1..18: mol_type = other DNA
gtgcacctctgcagcagg

SEQ ID NO: 415 - DNA, 18 bp, synthetic construct
  misc_feature 1..18: note = target site sequence
  source 1..18: mol_type = other DNA
tacgtgcacctctgcagc

SEQ ID NO: 416 - DNA, 18 bp, synthetic construct
  misc_feature 1..18: note = target site sequence
  source 1..18: mol_type = other DNA
gactacgtgcacctctgc

SEQ ID NO: 417 - DNA, 18 bp, synthetic construct
  misc_feature 1..18: note = target site sequence
  source 1..18: mol_type = other DNA
tcagactacgtgcacctc

SEQ ID NO: 418 - DNA, 18 bp, synthetic construct
  misc_feature 1..18: note = target site sequence
  source 1..18: mol_type = other DNA
cactcagactacgtgcac

SEQ ID NO: 419 - DNA, 18 bp, synthetic construct
  misc_feature 1..18: note = target site sequence
  source 1..18: mol_type = other DNA
cagcactcagactacgtg

SEQ ID NO: 420 - DNA, 18 bp, synthetic construct
  misc_feature 1..18: note = target site sequence
  source 1..18: mol_type = other DNA
ccgcagcactcagactac

SEQ ID NO: 421 - DNA, 18 bp, synthetic construct
  misc_feature 1..18: note = target site sequence
  source 1..18: mol_type = other DNA
agtccgcagcactcagac

SEQ ID NO: 422 - DNA, 18 bp, synthetic construct
  misc_feature 1..18: note = target site sequence
  source 1..18: mol_type = other DNA
ctgagtccgcagcactca

SEQ ID NO: 423 - DNA, 18 bp, synthetic construct
  misc_feature 1..18: note = target site sequence
  source 1..18: mol_type = other DNA
ctgctgagtccgcagcac

SEQ ID NO: 424 - DNA, 18 bp, synthetic construct
  misc_feature 1..18: note = target site sequence
  source 1..18: mol_type = other DNA
ggtctgctgagtccgcag

SEQ ID NO: 425 - DNA, 18 bp, synthetic construct
  misc_feature 1..18: note = target site sequence
  source 1..18: mol_type = other DNA
ccgggtctgctgagtccg

SEQ ID NO: 426 - DNA, 18 bp, synthetic construct
  misc_feature 1..18: note = target site sequence
  source 1..18: mol_type = other DNA
tggccgggtctgctgagt

SEQ ID NO: 427 - DNA, 18 bp, synthetic construct
  misc_feature 1..18: note = target site sequence
  source 1..18: mol_type = other DNA
cggtggccgggtctgctg

SEQ ID NO: 428 - DNA, 18 bp, synthetic construct
  misc_feature 1..18: note = target site sequence
  source 1..18: mol_type = other DNA
ggccggtggccgggtctg

SEQ ID NO: 429 - DNA, 18 bp, synthetic construct
  misc_feature 1..18: note = target site sequence
  source 1..18: mol_type = other DNA
taaggccggtggccgggt

SEQ ID NO: 430 - DNA, 18 bp, synthetic construct
  misc_feature 1..18: note = target site sequence
  source 1..18: mol_type = other DNA
gagtaaggccggtggccg

SEQ ID NO: 431 - DNA, 18 bp, synthetic construct
  misc_feature 1..18: note = target site sequence
  source 1..18: mol_type = other DNA
atggagtaaggccggtgg

SEQ ID NO: 432 - DNA, 18 bp, synthetic construct
  misc_feature 1..18: note = target site sequence
  source 1..18: mol_type = other DNA
gaaatggagtaaggccgg

SEQ ID NO: 433 - DNA, 18 bp, synthetic construct
  misc_feature 1..18: note = target site sequence
  source 1..18: mol_type = other DNA
agggaaatggagtaaggc

SEQ ID NO: 434 - DNA, 18 bp, synthetic construct
  misc_feature 1..18: note = target site sequence
  source 1..18: mol_type = other DNA
tccagggaaatggagtaa

SEQ ID NO: 435 - DNA, 18 bp, synthetic construct
  misc_feature 1..18: note = target site sequence
  source 1..18: mol_type = other DNA
ccttccagggaaatggag

SEQ ID NO: 436 - DNA, 18 bp, synthetic construct
  misc_feature 1..18: note = target site sequence
  source 1..18: mol_type = other DNA
tttccttccagggaaatg

SEQ ID NO: 437 - DNA, 18 bp, synthetic construct
  misc_feature 1..18: note = target site sequence
  source 1..18: mol_type = other DNA
gtctttccttccagggaa

SEQ ID NO: 438 - DNA, 18 bp, synthetic construct
  misc_feature 1..18: note = target site sequence
  source 1..18: mol_type = other DNA
ttggtctttccttccagg

SEQ ID NO: 439 - DNA, 18 bp, synthetic construct
  misc_feature 1..18: note = target site sequence
  source 1..18: mol_type = other DNA
actttggtctttccttcc

SEQ ID NO: 440 - DNA, 18 bp, synthetic construct
  misc_feature 1..18: note = target site sequence
  source 1..18: mol_type = other DNA
ctcactttggtctttcct

SEQ ID NO: 441 - DNA, 18 bp, synthetic construct
  misc_feature 1..18: note = target site sequence
  source 1..18: mol_type = other DNA
tccctcactttggtcttt

SEQ ID NO: 442 - DNA, 18 bp, synthetic construct
  misc_feature 1..18: note = target site sequence
  source 1..18: mol_type = other DNA
tgttccctcactttggtc

SEQ ID NO: 443 - DNA, 18 bp, synthetic construct
  misc_feature 1..18: note = target site sequence
  source 1..18: mol_type = other DNA
gagtgttccctcactttg

SEQ ID NO: 444 - DNA, 18 bp, synthetic construct
  misc_feature 1..18: note = target site sequence
  source 1..18: mol_type = other DNA
ttggagtgttccctcact

SEQ ID NO: 445 - DNA, 18 bp, synthetic construct
  misc_feature 1..18: note = target site sequence
  source 1..18: mol_type = other DNA
tccttggagtgttccctc

SEQ ID NO: 446 - DNA, 18 bp, synthetic construct
  misc_feature 1..18: note = target site sequence
  source 1..18: mol_type = other DNA
atttccttggagtgttcc

SEQ ID NO: 447 - DNA, 18 bp, synthetic construct
  misc_feature 1..18: note = target site sequence
  source 1..18: mol_type = other DNA
tgcatttccttggagtgt

SEQ ID NO: 448 - DNA, 18 bp, synthetic construct
  misc_feature 1..18: note = target site sequence
  source 1..18: mol_type = other DNA
gtgtgcatttccttggag

SEQ ID NO: 449 - DNA, 18 bp, synthetic construct
  misc_feature 1..18: note = target site sequence
  source 1..18: mol_type = other DNA
ctggtgtgcatttccttg

SEQ ID NO: 450 - DNA, 18 bp, synthetic construct
  misc_feature 1..18: note = target site sequence
  source 1..18: mol_type = other DNA
agcctggtgtgcatttcc

SEQ ID NO: 451 - DNA, 18 bp, synthetic construct
  misc_feature 1..18: note = target site sequence
  source 1..18: mol_type = other DNA
catagcctggtgtgcatt

SEQ ID NO: 452 - DNA, 18 bp, synthetic construct
  misc_feature 1..18: note = target site sequence
  source 1..18: mol_type = other DNA
tcccatagcctggtgtgc

SEQ ID NO: 453 - DNA, 18 bp, synthetic construct
  misc_feature 1..18: note = target site sequence
  source 1..18: mol_type = other DNA
acctcccatagcctggtg

SEQ ID NO: 454 - DNA, 18 bp, synthetic construct
  misc_feature 1..18: note = target site sequence
  source 1..18: mol_type = other DNA
gccacctcccatagcctg

SEQ ID NO: 455 - DNA, 18 bp, synthetic construct
  misc_feature 1..18: note = target site sequence
  source 1..18: mol_type = other DNA
tgagccacctcccatagc

SEQ ID NO: 456 - DNA, 18 bp, synthetic construct
  misc_feature 1..18: note = target site sequence
  source 1..18: mol_type = other DNA
ctctgagccacctcccat

SEQ ID NO: 457 - DNA, 18 bp, synthetic construct
  misc_feature 1..18: note = target site sequence
  source 1..18: mol_type = other DNA
atgctctgagccacctcc

SEQ ID NO: 458 - DNA, 18 bp, synthetic construct
  misc_feature 1..18: note = target site sequence
  source 1..18: mol_type = other DNA
cttatgctctgagccacc

SEQ ID NO: 459 - DNA, 18 bp, synthetic construct
  misc_feature 1..18: note = target site sequence
  source 1..18: mol_type = other DNA
aggcttatgctctgagcc

SEQ ID NO: 460 - DNA, 18 bp, synthetic construct
  misc_feature 1..18: note = target site sequence
  source 1..18: mol_type = other DNA
agcaggcttatgctctga

SEQ ID NO: 461 - DNA, 18 bp, synthetic construct
  misc_feature 1..18: note = target site sequence
  source 1..18: mol_type = other DNA
acaagcaggcttatgctc

SEQ ID NO: 462 - DNA, 18 bp, synthetic construct
  misc_feature 1..18: note = target site sequence
  source 1..18: mol_type = other DNA
ctaacaagcaggcttatg

SEQ ID NO: 463 - DNA, 18 bp, synthetic construct
  misc_feature 1..18: note = target site sequence
  source 1..18: mol_type = other DNA
tgcctaacaagcaggctt

SEQ ID NO: 464 - DNA, 18 bp, synthetic construct
  misc_feature 1..18: note = target site sequence
  source 1..18: mol_type = other DNA
gcttgcctaacaagcagg

SEQ ID NO: 465 - DNA, 18 bp, synthetic construct
  misc_feature 1..18: note = target site sequence
  source 1..18: mol_type = other DNA
gatgcttgcctaacaagc

SEQ ID NO: 466 - DNA, 18 bp, synthetic construct
  misc_feature 1..18: note = target site sequence
  source 1..18: mol_type = other DNA
attgatgcttgcctaaca

SEQ ID NO: 467 - DNA, 18 bp, synthetic construct
  misc_feature 1..18: note = target site sequence
  source 1..18: mol_type = other DNA
tacattgatgcttgccta

SEQ ID NO: 468 - DNA, 18 bp, synthetic construct
  misc_feature 1..18: note = target site sequence
  source 1..18: mol_type = other DNA
ttttacattgatgcttgc

SEQ ID NO: 469 - DNA, 18 bp, synthetic construct
  misc_feature 1..18: note = target site sequence
  source 1..18: mol_type = other DNA
aaattttacattgatgct

SEQ ID NO: 470 - DNA, 18 bp, synthetic construct
  misc_feature 1..18: note = target site sequence
  source 1..18: mol_type = other DNA
tccaaattttacattgat

SEQ ID NO: 471 - DNA, 18 bp, synthetic construct
  misc_feature 1..18: note = target site sequence
  source 1..18: mol_type = other DNA
tgctccaaattttacatt

SEQ ID NO: 472 - DNA, 18 bp, synthetic construct
  misc_feature 1..18: note = target site sequence
  source 1..18: mol_type = other DNA
tcatgctccaaattttac

SEQ ID NO: 473 - DNA, 18 bp, synthetic construct
  misc_feature 1..18: note = target site sequence
  source 1..18: mol_type = other DNA
ctgtcatgctccaaattt

SEQ ID NO: 474 - DNA, 18 bp, synthetic construct
  misc_feature 1..18: note = target site sequence
  source 1..18: mol_type = other DNA
caactgtcatgctccaaa

SEQ ID NO: 475 - DNA, 18 bp, synthetic construct
  misc_feature 1..18: note = target site sequence
  source 1..18: mol_type = other DNA
gcacaactgtcatgctcc

SEQ ID NO: 476 - DNA, 18 bp, synthetic construct
  misc_feature 1..18: note = target site sequence
  source 1..18: mol_type = other DNA
caggcacaactgtcatgc

SEQ ID NO: 477 - DNA, 18 bp, synthetic construct
  misc_feature 1..18: note = target site sequence
  source 1..18: mol_type = other DNA
atacaggcacaactgtca

SEQ ID NO: 478 - DNA, 18 bp, synthetic construct
  misc_feature 1..18: note = target site sequence
  source 1..18: mol_type = other DNA
gttatacaggcacaactg

SEQ ID NO: 479 - DNA, 18 bp, synthetic construct
  misc_feature 1..18: note = target site sequence
  source 1..18: mol_type = other DNA
ggggttatacaggcacaa

SEQ ID NO: 480 - DNA, 18 bp, synthetic construct
  misc_feature 1..18: note = target site sequence
  source 1..18: mol_type = other DNA
gttggggttatacaggca

SEQ ID NO: 481 - DNA, 18 bp, synthetic construct
  misc_feature 1..18: note = target site sequence
  source 1..18: mol_type = other DNA
agtgttggggttatacag

SEQ ID NO: 482 - DNA, 18 bp, synthetic construct
  misc_feature 1..18: note = target site sequence
  source 1..18: mol_type = other DNA
ctcagtgttggggttata

SEQ ID NO: 483 - DNA, 18 bp, synthetic construct
  misc_feature 1..18: note = target site sequence
  source 1..18: mol_type = other DNA
tccctcagtgttggggtt

SEQ ID NO: 484 - DNA, 18 bp, synthetic construct
  misc_feature 1..18: note = target site sequence
  source 1..18: mol_type = other DNA
actccgaggtagagcttg

SEQ ID NO: 485 - DNA, 18 bp, synthetic construct
  misc_feature 1..18: note = target site sequence
  source 1..18: mol_type = other DNA
gactccgaggtagagctt

SEQ ID NO: 486 - DNA, 18 bp, synthetic construct
  misc_feature 1..18: note = target site sequence
  source 1..18: mol_type = other DNA
cagactccgaggtagagc

SEQ ID NO: 487 - DNA, 18 bp, synthetic construct
  misc_feature 1..18: note = target site sequence
  source 1..18: mol_type = other DNA
tcagactccgaggtagag

SEQ ID NO: 488 - DNA, 18 bp, synthetic construct
  misc_feature 1..18: note = target site sequence
  source 1..18: mol_type = other DNA
cttcagactccgaggtag

SEQ ID NO: 489 - DNA, 18 bp, synthetic construct
  misc_feature 1..18: note = target site sequence
  source 1..18: mol_type = other DNA
tcttcagactccgaggta

SEQ ID NO: 490 - DNA, 18 bp, synthetic construct
  misc_feature 1..18: note = target site sequence
  source 1..18: mol_type = other DNA
actcttcagactccgagg

SEQ ID NO: 491 - DNA, 18 bp, synthetic construct
  misc_feature 1..18: note = target site sequence
  source 1..18: mol_type = other DNA
gactcttcagactccgag

SEQ ID NO: 492 - DNA, 18 bp, synthetic construct
  misc_feature 1..18: note = target site sequence
  source 1..18: mol_type = other DNA
ttgactcttcagactccg

SEQ ID NO: 493 - DNA, 18 bp, synthetic construct
  misc_feature 1..18: note = target site sequence
  source 1..18: mol_type = other DNA
gttgactcttcagactcc

SEQ ID NO: 494 - DNA, 18 bp, synthetic construct
  misc_feature 1..18: note = target site sequence
  source 1..18: mol_type = other DNA
ctgttgactcttcagact

SEQ ID NO: 495 - DNA, 18 bp, synthetic construct
  misc_feature 1..18: note = target site sequence
  source 1..18: mol_type = other DNA
actgttgactcttcagac

SEQ ID NO: 496 - DNA, 18 bp, synthetic construct
  misc_feature 1..18: note = target site sequence
  source 1..18: mol_type = other DNA
acactgttgactcttcag

SEQ ID NO: 497 - DNA, 18 bp, synthetic construct
  misc_feature 1..18: note = target site sequence
  source 1..18: mol_type = other DNA
gacactgttgactcttca

SEQ ID NO: 498 - DNA, 18 bp, synthetic construct
  misc_feature 1..18: note = target site sequence
  source 1..18: mol_type = other DNA
ctgacactgttgactctt

SEQ ID NO: 499 - DNA, 18 bp, synthetic construct
  misc_feature 1..18: note = target site sequence
  source 1..18: mol_type = other DNA
tctgacactgttgactct

SEQ ID NO: 500 - DNA, 18 bp, synthetic construct
  misc_feature 1..18: note = target site sequence
  source 1..18: mol_type = other DNA
attctgacactgttgact

SEQ ID NO: 501 - DNA, 18 bp, synthetic construct
  misc_feature 1..18: note = target site sequence
  source 1..18: mol_type = other DNA
gattctgacactgttgac

SEQ ID NO: 502 - DNA, 18 bp, synthetic construct
  misc_feature 1..18: note = target site sequence
  source 1..18: mol_type = other DNA
tggattctgacactgttg

SEQ ID NO: 503 - DNA, 18 bp, synthetic construct
  misc_feature 1..18: note = target site sequence
  source 1..18: mol_type = other DNA
atggattctgacactgtt

SEQ ID NO: 504 - DNA, 18 bp, synthetic construct
  misc_feature 1..18: note = target site sequence
  source 1..18: mol_type = other DNA
ccatggattctgacactg

SEQ ID NO: 505 - DNA, 18 bp, synthetic construct
  misc_feature 1..18: note = target site sequence
  source 1..18: mol_type = other DNA
cccatggattctgacact

SEQ ID NO: 506 - DNA, 18 bp, synthetic construct
  misc_feature 1..18: note = target site sequence
  source 1..18: mol_type = other DNA
ttcccatggattctgaca

SEQ ID NO: 507 - DNA, 18 bp, synthetic construct
  misc_feature 1..18: note = target site sequence
  source 1..18: mol_type = other DNA
cttcccatggattctgac

SEQ ID NO: 508 - DNA, 18 bp, synthetic construct
  misc_feature 1..18: note = target site sequence
  source 1..18: mol_type = other DNA
atcttcccatggattctg

SEQ ID NO: 509 - DNA, 18 bp, synthetic construct
  misc_feature 1..18: note = target site sequence
  source 1..18: mol_type = other DNA
catcttcccatggattct

SEQ ID NO: 510 - DNA, 18 bp, synthetic construct
  misc_feature 1..18: note = target site sequence
  source 1..18: mol_type = other DNA
aacatcttcccatggatt

SEQ ID NO: 511 - DNA, 18 bp, synthetic construct
  misc_feature 1..18: note = target site sequence
  source 1..18: mol_type = other DNA
gaacatcttcccatggat

SEQ ID NO: 512 - DNA, 18 bp, synthetic construct
  misc_feature 1..18: note = target site sequence
  source 1..18: mol_type = other DNA
cagaacatcttcccatgg

SEQ ID NO: 513 - DNA, 18 bp, synthetic construct
  misc_feature 1..18: note = target site sequence
  source 1..18: mol_type = other DNA
ccagaacatcttcccatg

SEQ ID NO: 514 - DNA, 18 bp, synthetic construct
  misc_feature 1..18: note = target site sequence
  source 1..18: mol_type = other DNA
ccccagaacatcttccca

SEQ ID NO: 515 - DNA, 18 bp, synthetic construct
  misc_feature 1..18: note = target site sequence
  source 1..18: mol_type = other DNA
tccccagaacatcttccc

SEQ ID NO: 516 - DNA, 18 bp, synthetic construct
  misc_feature 1..18: note = target site sequence
  source 1..18: mol_type = other DNA
cctccccagaacatcttc

SEQ ID NO: 517 - DNA, 18 bp, synthetic construct
  misc_feature 1..18: note = target site sequence
  source 1..18: mol_type = other DNA
acctccccagaacatctt

SEQ ID NO: 518 - DNA, 18 bp, synthetic construct
  misc_feature 1..18: note = target site sequence
  source 1..18: mol_type = other DNA
tcacctccccagaacatc

SEQ ID NO: 519 - DNA, 18 bp, synthetic construct
  misc_feature 1..18: note = target site sequence
  source 1..18: mol_type = other DNA
gtcacctccccagaacat

SEQ ID NO: 520 - DNA, 18 bp, synthetic construct
  misc_feature 1..18: note = target site sequence
  source 1..18: mol_type = other DNA
ttgtcacctccccagaac

SEQ ID NO: 521 - DNA, 18 bp, synthetic construct
  misc_feature 1..18: note = target site sequence
  source 1..18: mol_type = other DNA
gttgtcacctccccagaa

SEQ ID NO: 522 - DNA, 18 bp, synthetic construct
  misc_feature 1..18: note = target site sequence
  source 1..18: mol_type = other DNA
cagttgtcacctccccag

SEQ ID NO: 523 - DNA, 18 bp, synthetic construct
  misc_feature 1..18: note = target site sequence
  source 1..18: mol_type = other DNA
ccagttgtcacctcccca

SEQ ID NO: 524 - DNA, 18 bp, synthetic construct
  misc_feature 1..18: note = target site sequence
  source 1..18: mol_type = other DNA
gcccagttgtcacctccc

SEQ ID NO: 525 - DNA, 18 bp, synthetic construct
  misc_feature 1..18: note = target site sequence
  source 1..18: mol_type = other DNA
ggcccagttgtcacctcc

SEQ ID NO: 526 - DNA, 18 bp, synthetic construct
  misc_feature 1..18: note = target site sequence
  source 1..18: mol_type = other DNA
caggcccagttgtcacct

SEQ ID NO: 527 - DNA, 18 bp, synthetic construct
  misc_feature 1..18: note = target site sequence
  source 1..18: mol_type = other DNA
gcaggcccagttgtcacc

SEQ ID NO: 528 - DNA, 18 bp, synthetic construct
  misc_feature 1..18: note = target site sequence
  source 1..18: mol_type = other DNA
gtgcaggcccagttgtca

SEQ ID NO: 529 - DNA, 18 bp, synthetic construct
  misc_feature 1..18: note = target site sequence
  source 1..18: mol_type = other DNA
ggtgcaggcccagttgtc

SEQ ID NO: 530 - DNA, 18 bp, synthetic construct
  misc_feature 1..18: note = target site sequence
  source 1..18: mol_type = other DNA
caggtgcaggcccagttg

SEQ ID NO: 531 - DNA, 18 bp, synthetic construct
  misc_feature 1..18: note = target site sequence
  source 1..18: mol_type = other DNA
gcaggtgcaggcccagtt

SEQ ID NO: 532 - DNA, 18 bp, synthetic construct
  misc_feature 1..18: note = target site sequence
  source 1..18: mol_type = other DNA
cagcaggtgcaggcccag

SEQ ID NO: 533 - DNA, 18 bp, synthetic construct
  misc_feature 1..18: note = target site sequence
  source 1..18: mol_type = other DNA
gcagcaggtgcaggccca

SEQ ID NO: 534 - DNA, 18 bp, synthetic construct
  misc_feature 1..18: note = target site sequence
  source 1..18: mol_type = other DNA
ctgcagcaggtgcaggcc

SEQ ID NO: 535 - DNA, 18 bp, synthetic construct
  misc_feature 1..18: note = target site sequence
  source 1..18: mol_type = other DNA
tctgcagcaggtgcaggc

SEQ ID NO: 536 - DNA, 18 bp, synthetic construct
  misc_feature 1..18: note = target site sequence
  source 1..18: mol_type = other DNA
cctctgcagcaggtgcag

SEQ ID NO: 537 - DNA, 18 bp, synthetic construct
  misc_feature 1..18: note = target site sequence
  source 1..18: mol_type = other DNA
acctctgcagcaggtgca

SEQ ID NO: 538 - DNA, 18 bp, synthetic construct
  misc_feature 1..18: note = target site sequence
  source 1..18: mol_type = other DNA
gcacctctgcagcaggtg

SEQ ID NO: 539 - DNA, 18 bp, synthetic construct
  misc_feature 1..18: note = target site sequence
  source 1..18: mol_type = other DNA
tgcacctctgcagcaggt

SEQ ID NO: 540 - DNA, 18 bp, synthetic construct
  misc_feature 1..18: note = target site sequence
  source 1..18: mol_type = other DNA
cgtgcacctctgcagcag

SEQ ID NO: 541 - DNA, 18 bp, synthetic construct
  misc_feature 1..18: note = target site sequence
  source 1..18: mol_type = other DNA
acgtgcacctctgcagca

SEQ ID NO: 542 - DNA, 18 bp, synthetic construct
  misc_feature 1..18: note = target site sequence
  source 1..18: mol_type = other DNA
ctacgtgcacctctgcag

SEQ ID NO: 543 - DNA, 18 bp, synthetic construct
  misc_feature 1..18: note = target site sequence
  source 1..18: mol_type = other DNA
actacgtgcacctctgca

SEQ ID NO: 544 - DNA, 18 bp, synthetic construct
  misc_feature 1..18: note = target site sequence
  source 1..18: mol_type = other DNA
agactacgtgcacctctg

SEQ ID NO: 545 - DNA, 18 bp, synthetic construct
  misc_feature 1..18: note = target site sequence
  source 1..18: mol_type = other DNA
cagactacgtgcacctct

SEQ ID NO: 546 - DNA, 18 bp, synthetic construct
  misc_feature 1..18: note = target site sequence
  source 1..18: mol_type = other DNA
ctcagactacgtgcacct

SEQ ID NO: 547 - DNA, 18 bp, synthetic construct
  misc_feature 1..18: note = target site sequence
  source 1..18: mol_type = other DNA
actcagactacgtgcacc

SEQ ID NO: 548 - DNA, 18 bp, synthetic construct
  misc_feature 1..18: note = target site sequence
  source 1..18: mol_type = other DNA
gcactcagactacgtgca

SEQ ID NO: 549 - DNA, 18 bp, synthetic construct
  misc_feature 1..18: note = target site sequence
  source 1..18: mol_type = other DNA
agcactcagactacgtgc

SEQ ID NO: 550 - DNA, 18 bp, synthetic construct
  misc_feature 1..18: note = target site sequence
  source 1..18: mol_type = other DNA
gcagcactcagactacgt

SEQ ID NO: 551 - DNA, 18 bp, synthetic construct
  misc_feature 1..18: note = target site sequence
  source 1..18: mol_type = other DNA
cgcagcactcagactacg

SEQ ID NO: 552 - DNA, 18 bp, synthetic construct
  misc_feature 1..18: note = target site sequence
  source 1..18: mol_type = other DNA
tccgcagcactcagacta

SEQ ID NO: 553 - DNA, 18 bp, synthetic construct
  misc_feature 1..18: note = target site sequence
  source 1..18: mol_type = other DNA
gtccgcagcactcagact

SEQ ID NO: 554 - DNA, 18 bp, synthetic construct
  misc_feature 1..18: note = target site sequence
  source 1..18: mol_type = other DNA
gagtccgcagcactcaga

SEQ ID NO: 555 - DNA, 18 bp, synthetic construct
  misc_feature 1..18: note = target site sequence
  source 1..18: mol_type = other DNA
tgagtccgcagcactcag

SEQ ID NO: 556 - DNA, 18 bp, synthetic construct
  misc_feature 1..18: note = target site sequence
  source 1..18: mol_type = other DNA
gctgagtccgcagcactc

SEQ ID NO: 557 - DNA, 18 bp, synthetic construct
  misc_feature 1..18: note = target site sequence
  source 1..18: mol_type = other DNA
tgctgagtccgcagcact

SEQ ID NO: 558 - DNA, 18 bp, synthetic construct
  misc_feature 1..18: note = target site sequence
  source 1..18: mol_type = other DNA
tctgctgagtccgcagca

SEQ ID NO: 559 - DNA, 18 bp, synthetic construct
  misc_feature 1..18: note = target site sequence
  source 1..18: mol_type = other DNA
gtctgctgagtccgcagc

SEQ ID NO: 560 - DNA, 18 bp, synthetic construct
  misc_feature 1..18: note = target site sequence
  source 1..18: mol_type = other DNA
gggtctgctgagtccgca

SEQ ID NO: 561 - DNA, 18 bp, synthetic construct
  misc_feature 1..18: note = target site sequence
  source 1..18: mol_type = other DNA
cgggtctgctgagtccgc

SEQ ID NO: 562 - DNA, 18 bp, synthetic construct
  misc_feature 1..18: note = target site sequence
  source 1..18: mol_type = other DNA
gccgggtctgctgagtcc

SEQ ID NO: 563 - DNA, 18 bp, synthetic construct
  misc_feature 1..18: note = target site sequence
  source 1..18: mol_type = other DNA
ggccgggtctgctgagtc

SEQ ID NO: 564 - DNA, 18 bp, synthetic construct
  misc_feature 1..18: note = target site sequence
  source 1..18: mol_type = other DNA
gtggccgggtctgctgag

SEQ ID NO: 565 - DNA, 18 bp, synthetic construct
  misc_feature 1..18: note = target site sequence
  source 1..18: mol_type = other DNA
ggtggccgggtctgctga

SEQ ID NO: 566 - DNA, 18 bp, synthetic construct
  misc_feature 1..18: note = target site sequence
  source 1..18: mol_type = other DNA
ccggtggccgggtctgct

SEQ ID NO: 567 - DNA, 18 bp, synthetic construct
  misc_feature 1..18: note = target site sequence
  source 1..18: mol_type = other DNA
gccggtggccgggtctgc

SEQ ID NO: 568 - DNA, 18 bp, synthetic construct
  misc_feature 1..18: note = target site sequence
  source 1..18: mol_type = other DNA
aggccggtggccgggtct

SEQ ID NO: 569 - DNA, 18 bp, synthetic construct
  misc_feature 1..18: note = target site sequence
  source 1..18: mol_type = other DNA
aaggccggtggccgggtc

SEQ ID NO: 570 - DNA, 18 bp, synthetic construct
  misc_feature 1..18: note = target site sequence
  source 1..18: mol_type = other DNA
gtaaggccggtggccggg

SEQ ID NO: 571 - DNA, 18 bp, synthetic construct
  misc_feature 1..18: note = target site sequence
  source 1..18: mol_type = other DNA
agtaaggccggtggccgg

SEQ ID NO: 572 - DNA, 18 bp, synthetic construct
  misc_feature 1..18: note = target site sequence
  source 1..18: mol_type = other DNA
ggagtaaggccggtggcc

SEQ ID NO: 573 - DNA, 18 bp, synthetic construct
  misc_feature 1..18: note = target site sequence
  source 1..18: mol_type = other DNA
tggagtaaggccggtggc

SEQ ID NO: 574 - DNA, 18 bp, synthetic construct
  misc_feature 1..18: note = target site sequence
  source 1..18: mol_type = other DNA
aatggagtaaggccggtg

SEQ ID NO: 575 - DNA, 18 bp, synthetic construct
  misc_feature 1..18: note = target site sequence
  source 1..18: mol_type = other DNA
aaatggagtaaggccggt

SEQ ID NO: 576 - DNA, 18 bp, synthetic construct
  misc_feature 1..18: note = target site sequence
  source 1..18: mol_type = other DNA
ggaaatggagtaaggccg

SEQ ID NO: 577 - DNA, 18 bp, synthetic construct
  misc_feature 1..18: note = target site sequence
  source 1..18: mol_type = other DNA
gggaaatggagtaaggcc

SEQ ID NO: 578 - DNA, 18 bp, synthetic construct
  misc_feature 1..18: note = target site sequence
  source 1..18: mol_type = other DNA
cagggaaatggagtaagg

SEQ ID NO: 579 - DNA, 18 bp, synthetic construct
  misc_feature 1..18: note = target site sequence
  source 1..18: mol_type = other DNA
ccagggaaatggagtaag

SEQ ID NO: 580 - DNA, 18 bp, synthetic construct
  misc_feature 1..18: note = target site sequence
  source 1..18: mol_type = other DNA
ttccagggaaatggagta

SEQ ID NO: 581 - DNA, 18 bp, synthetic construct
  misc_feature 1..18: note = target site sequence
  source 1..18: mol_type = other DNA
cttccagggaaatggagt

SEQ ID NO: 582 - DNA, 18 bp, synthetic construct
  misc_feature 1..18: note = target site sequence
  source 1..18: mol_type = other DNA
tccttccagggaaatgga

SEQ ID NO: 583 - DNA, 18 bp, synthetic construct
  misc_feature 1..18: note = target site sequence
  source 1..18: mol_type = other DNA
ttccttccagggaaatgg

SEQ ID NO: 584 - DNA, 18 bp, synthetic construct
  misc_feature 1..18: note = target site sequence
  source 1..18: mol_type = other DNA
ctttccttccagggaaat

SEQ ID NO: 585 - DNA, 18 bp, synthetic construct
  misc_feature 1..18: note = target site sequence
  source 1..18: mol_type = other DNA
tctttccttccagggaaa

SEQ ID NO: 586 - DNA, 18 bp, synthetic construct
  misc_feature 1..18: note = target site sequence
  source 1..18: mol_type = other DNA
ggtctttccttccaggga

SEQ ID NO: 587 - DNA, 18 bp, synthetic construct
  misc_feature 1..18: note = target site sequence
  source 1..18: mol_type = other DNA
tggtctttccttccaggg

SEQ ID NO: 588 - DNA, 18 bp, synthetic construct
  misc_feature 1..18: note = target site sequence
  source 1..18: mol_type = other DNA
tttggtctttccttccag

SEQ ID NO: 589 - DNA, 18 bp, synthetic construct
  misc_feature 1..18: note = target site sequence
  source 1..18: mol_type = other DNA
ctttggtctttccttcca

SEQ ID NO: 590 - DNA, 5353 bp, Mus musculus
  source 1..5353: mol_type = genomic DNA
ctagggtaaaaccgtgagactcggtctggaaatctggcctgagaggacagcctggcaatcctcagccggggtggggacgtctgccgaagatccttggactccagcaaccagtggtcgccaccgtccatccaccctaaggcccagtttgcacggcggagaacagctgtgcagccacgctggacactcaccccgcccgagttgagcccgcccccgggactacaggaccaataagtgatgaatatacccgcgcgtcacggagcaccggccaatcgcggacggccacgaccctagaaaggctgggcgcggcaggaggccacggggcggtggcggcgctggcgtagacgtttcctggctatggtggtggtggcagcggcgccgagcgcggccacggcggcccccaaagtgctactcttatctggccagcccgcctccggcggccgggcgctgccgctcatggtacccggtccgcgggcagcagggtcggaggcgagcgggacaccgcaggctcgcaagcggcagcggctcacgcacctgagcccggaggagaaagcgctgcggaggtgggcccggcgggcaaggctggggcgcggggcggcaggactgggattgggactctctcgtgtgtgccagctggtgggctccgtacggtgggttagattcacctctagtgtctaacctgggaagcggagctgagggggatgcccctccgaaggtctgcgtcgggggtgtgtgcaggagctcccgacacaggcacagaagaaggtgcccgacgcccagtcctctgtaaatgctcgctctttgtggtcgtagggtaggaaccgctccagctgtcattgcagccacttgggaaccccaccctgggaaccgagtccacagcgtccggcatcccgagagtttggcttggggagggacagttggtagcgtccccgccgccttcacggatatcgctctagcaaggagcctgtgggacggaattggacccagaaagtagcgggggaggagggaagaagcatatgacgcaacgggaatgtatcagcccggtggtaaaatgagatccgggtggacagccgcacgggagagaatcaagcaagtcttcaaggcctgtggatagaaagcagcgtgtgtatgcgtgtgcgtgtgcgttttgataggagctttaagcgtgtttacttgctaagccttattctgtaaagtcaacgaaagcaccagctggccacgtctacaaatgaagacacatgaaagctggagatgactcagttatgttccctgtctcctccccaaggaaactgaaaaacagagtagcagcgcagactgctcgagatagaaagaaagcccggatgagcgagctggagcagcaagtggtggatttggaagaagaggtaaagggacttcaggccatgctttcatcccatccatatcagggcccatcctaaactgcttcagccctttagaatacaacccaaagtgccatttaaagtttaaccagcctagcagataggccgtgaaagcagacgtgactcaccctggcctgccctcccctcggagattagccaggttggatagatcattggttgcttaagctgtagcgccgcctgtctttgccaaaggctcactaacgctgcccttccttctgggatccccccccccccgcgcgcccccaatcctcccaccctctgtatcctttctgctgtcagtgcccttttgtgcccctccaccccggcatccttttaccctttggggagttattttagtttctaagttaagtttagttaactttagctatttctagcgtttctaggcattgccacatttacgtccatttatatgcgcacgtgcgccctggtttgagtttgggtcacctcactttgtaatacactttccaaatttatacattttccctgctagtttcctttctctatacaggcgagtggtacctcactgtgtgtgcaccccactttcacggttctctgggcatctgtgctcagcatctaggctgccaccatttctttgccattggaccactaccacttgcaccaacacttgccatttcaagacaggatggtgaattatttaaagattatttttagatagggtcttaggttggcctgtaactcatggcatgcctcctgttttaccatgctgacattacaggcagtgaaccaccttgccatactttttttttttaaaggtagtgtattaacacaactgtaaattcaagctgcaagtgacctttttttttggctgaaatctgcgagtagtacttgtaggcattatgttgtttctgtcaccattgaaaacacttttgttttcttcagagattggccttgaataaacttgcttctcccgcctcagcctgcttgagtgttcaatggcatttttggggggacagcttgatgtctcccaggctgtgctctaacttgctgtgtagccaaagatgaccccaaatttgtttctcttgctgctatgtcccaggtgctgggattacagtttatgcagagctgaagatggagcccagggctgcaagcctgggagggcaggccttctcccaactcctctgtcccattagccaccggtgacagaatggctgtgacccgcaccagcagggaaacagctggagcagaacttgcagtggattctttagtgacggaaccacacggtctaaccgcacggcctcttatgtgattccttacagaaccacaaactccagctagaaaatcagcttttacgggagaaaactcacggccttgtggttgagaaccaggagttaagaacacgcttgggaatggacacgctggatcctgacgaggttccagaggtggaggccaaggtaagtattgggagacctggctgcagcactacctggctgcaggtttgtgttctggacctccaatcaaatccttttctcttttcctttatgagacaaggtcttaatgtctaattttggctggtcttgaacttgtgtcagttcttttgcttctaagtagtaggactataagcacctgcccctgtgcctagctgaggaatcctgaattttccctgtttccttgaactaaacttatgatcttcttgccttagccttccaagcgctggaattacatgcatgaacaagtggtttgtttcttggcttttttgggggatagggtgtcatgtagtccaggttggcctcaaacttgctctgtagctgataatcctacctccaccttccagatgttaccattacaggcagatgttcctttgtgtggttatgtaggtgtgtatgtgtacatgggtgtgggtttatacacatctctgcttacgtacagaggcctaaggagcatatagatgtcttgccctagcactgtccaccctgctcctctgcagcagagtgtctcactgaatctggggctaggcaggtggacagcaagccctggtgaacttcctgtttctgcctcccttgatgctgaggatttgaacttgggtcttcaggattgtacagcaagcacattatattcagagccacctccccagttcctttcgagccctttgaggagcagagactcacagctacccagcatgtatatccttggcaacttttactcactgtggtctttccttccaggggagtggagtaaggctggtggccgggtctgctgagtccgcagcactcagactatgtgcacctctgcagcaggtgcaggcccagttgtcacctccccagaacatcttcccatggactctgacactgttgcctcttcagattctgaggtagagcttattctgtagcctaagtggcgtgtgacacgcttagccaggcaaacggagaagttagtattggtggggttaggattaagcactttcctagtctgcttaagtggatggagtagggggaaactgttccgtgggtgggtcctatgatctgagagcataagtctggtggatggctgggtcctgtgatctgagagtgtaagccctaagtaacattgtggaacccagtactaaaagtatttctggtagactgtcacattcattctaatagtgaactcttttgtgttttgcctcttgtagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaattaaaaaaaaagcaacacagcgtcctgttctgtgatttctagggctgttgtaatttctctttattgttggctaaaggagtaatttatccaactaaagtgagcataccactttttaaagtca

SEQ ID NO: 591 - DNA, 2264 bp, Mus musculus
  source 1..2264: mol_type = genomic DNA
ctagggtaaaaccgtgagactcggtctggaaatctggcctgagaggacagcctggcaatcctcagccggggtggggacgtctgccgaagatccttggactccagcaaccagtggtcgccaccgtccatccaccctaaggcccagtttgcacggcggagaacagctgtgcagccacgctggacactcaccccgcccgagttgagcccgcccccgggactacaggaccaataagtgatgaatatacccgcgcgtcacggagcaccggccaatcgcggacggccacgaccctagaaaggctgggcgcggcaggaggccacggggcggtggcggcgctggcgtagacgtttcctggctatggtggtggtggcagcggcgccgagcgcggccacggcggcccccaaagtgctactcttatctggccagcccgcctccggcggccgggcgctgccgctcatggtacccggtccgcgggcagcagggtcggaggcgagcgggacaccgcaggctcgcaagcggcagcggctcacgcacctgagcccggaggagaaagcgctgcggaggaaactgaaaaacagagtagcagcgcagactgctcgagatagaaagaaagcccggatgagcgagctggagcagcaagtggtggatttggaagaagagaaccacaaactccagctagaaaatcagcttttacgggagaaaactcacggccttgtggttgagaaccaggagttaagaacacgcttgggaatggacacgctggatcctgacgaggttccagaggtggaggccaaggggagtggagtaaggctggtggccgggtctgctgagtccgcagcactcagactatgtgcacctctgcagcaggtgcaggcccagttgtcacctccccagaacatcttcccatggactctgacactgttgcctcttcagattctgagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaattaaaaaaaaagcaacacagcgtcctgttctgtgatttctagggctgttgtaatttctctttattgttggctaaaggagtaatttatccaactaaagtgagcataccactttttaaagtcaaaaaaaaaaaaaaaaaa

SEQ ID NO: 592 - protein, 267 aa, Mus musculus
MVVVAAAPSAATAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKGSGVRLVAGSAESAALRLCAPLQQVQAQLSPPQNIFPWTLTLLPLQILSLISFWAFWTSWTLSCFSNVLPQSLLVWRNSQRSTQKDLVPYQPPFLCQWGPHQPSWKPLMNSFVLTMYTPSL

SEQ ID NO: 593 - DNA, 2238 bp, Mus musculus
  source 1..2238: mol_type = genomic DNA
ctagggtaaaaccgtgagactcggtctggaaatctggcctgagaggacagcctggcaatcctcagccggggtggggacgtctgccgaagatccttggactccagcaaccagtggtcgccaccgtccatccaccctaaggcccagtttgcacggcggagaacagctgtgcagccacgctggacactcaccccgcccgagttgagcccgcccccgggactacaggaccaataagtgatgaatatacccgcgcgtcacggagcaccggccaatcgcggacggccacgaccctagaaaggctgggcgcggcaggaggccacggggcggtggcggcgctggcgtagacgtttcctggctatggtggtggtggcagcggcgccgagcgcggccacggcggcccccaaagtgctactcttatctggccagcccgcctccggcggccgggcgctgccgctcatggtacccggtccgcgggcagcagggtcggaggcgagcgggacaccgcaggctcgcaagcggcagcggctcacgcacctgagcccggaggagaaagcgctgcggaggaaactgaaaaacagagtagcagcgcagactgctcgagatagaaagaaagcccggatgagcgagctggagcagcaagtggtggatttggaagaagagaaccacaaactccagctagaaaatcagcttttacgggagaaaactcacggccttgtggttgagaaccaggagttaagaacacgcttgggaatggacacgctggatcctgacgaggttccagaggtggaggccaaggggagtggagtaaggctggtggccgggtctgctgagtccgcagcaggtgcaggcccagttgtcacctccccagaacatcttcccatggactctgacactgttgcctcttcagattctgagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaattaaaaaaaaagcaacacagcgtcctgttctgtgatttctagggctgttgtaatttctctttattgttggctaaaggagtaatttatccaactaaagtgagcataccactttttaaagtcaaaaaaaaaaaaaaaaaa

SEQ ID NO: 594 - protein, 371 aa, Mus musculus
MVVVAAAPSAATAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKGSGVRLVAGSAESAAGAGPVVTSPEHLPMDSDTVASSDSESDILLGILDKLDPVMFFKCPSPESASLEELPEVYPEGPSSLPASLSLSVGTSSAKLEAINELIRFDHVYTKPLVLEIPSETESQTNVVVKIEEAPLSSSEEDHPEFIVSVKKEPLEDDFIPELGISNLLSSSHCLRPPSCLLDAHSDCGYEGSPSPFSDMSSPLGTDHSWEDTFANELFPQLISV

SEQ ID NO: 595 - DNA, 2118 bp, Mus musculus
  source 1..2118: mol_type = genomic DNA
ctagggtaaaaccgtgagactcggtctggaaatctggcctgagaggacagcctggcaatcctcagccggggtggggacgtctgccgaagatccttggactccagcaaccagtggtcgccaccgtccatccaccctaaggcccagtttgcacggcggagaacagctgtgcagccacgctggacactcaccccgcccgagttgagcccgcccccgggactacaggaccaataagtgatgaatatacccgcgcgtcacggagcaccggccaatcgcggacggccacgaccctagaaaggctgggcgcggcaggaggccacggggcggtggcggcgctggcgtagacgtttcctggctatggtggtggtggcagcggcgccgagcgcggccacggcggcccccaaagtgctactcttatctggccagcccgcctccggcggccgggcgctgccgctcatggtacccggtccgcgggcagcagggtcggaggcgagcgggacaccgcaggctcgcaagcggcagcggctcacgcacctgagcccggaggagaaagcgctgcggaggaaactgaaaaacagagtagcagcgcagactgctcgagatagaaagaaagcccggatgagcgagctggagcagcaagtggtggatttggaagaagagaaccacaaactccagctagaaaatcagcttttacgggagaaaactcacggccttgtggttgagaaccaggagttaagaacacgcttgggaatggacacgctggatcctgacgaggttccagaggtggaggccaagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaattaaaaaaaaagcaacacagcgtcctgttctgtgatttctagggctgttgtaatttctctttattgttggctaaaggagtaatttatccaactaaagtgagcataccactttttaaagtcaaaaaaaaaaaaaaaaaa

SEQ ID NO: 596 - protein, 331 aa, Mus musculus
MVVVAAAPSAATAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKSDILLGILDKLDPVMFFKCPSPESASLEELPEVYPEGPSSLPASLSLSVGTSSAKLEAINELIRFDHVYTKPLVLEIPSETESQTNVVVKIEEAPLSSSEEDHPEFIVSVKKEPLEDDFIPELGISNLLSSSHCLRPPSCLLDAHSDCGYEGSPSPFSDMSSPLGTDHSWEDTFANELFPQLISV

SEQ ID NO: 597 - DNA, 18 bp, synthetic construct
  misc_feature 1..18: note = motif sequence
  source 1..18: mol_type = other DNA
tccatgggaagatgttct

SEQ ID NO: 598 - DNA, 18 bp, synthetic construct
  misc_feature 1..18: note = motif sequence
  source 1..18: mol_type = other DNA
ggaagatgttctggggag

SEQ ID NO: 599 - DNA, 18 bp, synthetic construct
  misc_feature 1..18: note = motif sequence
  source 1..18: mol_type = other DNA
tgttctggggaggtgaca

SEQ ID NO: 600 - DNA, 18 bp, synthetic construct
  misc_feature 1..18: note = motif sequence
  source 1..18: mol_type = other DNA
ggggaggtgacaactggg

SEQ ID NO: 601 - DNA, 18 bp, synthetic construct
  misc_feature 1..18: note = motif sequence
  source 1..18: mol_type = other DNA
gtgacaactgggcctgca

SEQ ID NO: 602 - DNA, 18 bp, synthetic construct
  misc_feature 1..18: note = motif sequence
  source 1..18: mol_type = other DNA
actgggcctgcacctgct

SEQ ID NO: 603 - DNA, 18 bp, synthetic construct
  misc_feature 1..18: note = motif sequence
  source 1..18: mol_type = other DNA
cctgcacctgctgcagag

SEQ ID NO: 604 - DNA, 18 bp, synthetic construct
  misc_feature 1..18: note = motif sequence
  source 1..18: mol_type = other DNA
cctgctgcagaggtgcac

SEQ ID NO: 605 - DNA, 18 bp, synthetic construct
  misc_feature 1..18: note = motif sequence
  source 1..18: mol_type = other DNA
tgagtgctgcggactcag

SEQ ID NO: 606 - DNA, 18 bp, synthetic construct
  misc_feature 1..18: note = motif sequence
  source 1..18: mol_type = other DNA
ctgcggactcagcagacc

SEQ ID NO: 607 - DNA, 18 bp, synthetic construct
  misc_feature 1..18: note = motif sequence
  source 1..18: mol_type = other DNA
actcagcagacccggcca

SEQ ID NO: 608 - DNA, 18 bp, synthetic construct
  misc_feature 1..18: note = motif sequence
  source 1..18: mol_type = other DNA
catgggaagatgttctgg

SEQ ID NO: 609 - DNA, 18 bp, synthetic construct
  misc_feature 1..18: note = motif sequence
  source 1..18: mol_type = other DNA
tgggaagatgttctgggg

SEQ ID NO: 610 - DNA, 18 bp, synthetic construct
  misc_feature 1..18: note = motif sequence
  source 1..18: mol_type = other DNA
aagatgttctggggaggt

SEQ ID NO: 611 - DNA, 18 bp, synthetic construct
  misc_feature 1..18: note = motif sequence
  source 1..18: mol_type = other DNA
gatgttctggggaggtga

SEQ ID NO: 612 - DNA, 18 bp, synthetic construct
  misc_feature 1..18: note = motif sequence
  source 1..18: mol_type = other DNA
ttctggggaggtgacaac

SEQ ID NO: 613 - DNA, 18 bp, synthetic construct
  misc_feature 1..18: note = motif sequence
  source 1..18: mol_type = other DNA
ctggggaggtgacaactg

SEQ ID NO: 614 - DNA, 18 bp, synthetic construct
  misc_feature 1..18: note = motif sequence
  source 1..18: mol_type = other DNA
ggaggtgacaactgggcc

SEQ ID NO: 615 - DNA, 18 bp, synthetic construct
  misc_feature 1..18: note = motif sequence
  source 1..18: mol_type = other DNA
aggtgacaactgggcctg

SEQ ID NO: 616 - DNA, 18 bp, synthetic construct
  misc_feature 1..18: note = motif sequence
  source 1..18: mol_type = other DNA
gacaactgggcctgcacc

SEQ ID NO: 617 - DNA, 18 bp, synthetic construct
  misc_feature 1..18: note = motif sequence
  source 1..18: mol_type = other DNA
caactgggcctgcacctg

SEQ ID NO: 618 - DNA, 18 bp, synthetic construct
  misc_feature 1..18: note = motif sequence
  source 1..18: mol_type = other DNA
tgggcctgcacctgctgc

SEQ ID NO: 619 - DNA, 18 bp, synthetic construct
  misc_feature 1..18: note = motif sequence
  source 1..18: mol_type = other DNA
ggcctgcacctgctgcag

SEQ ID NO: 620 - DNA, 18 bp, synthetic construct
  misc_feature 1..18: note = motif sequence
  source 1..18: mol_type = other DNA
cacctgctgcagaggtgc

SEQ ID NO: 621 - DNA, 18 bp, synthetic construct
  misc_feature 1..18: note = motif sequence
  source 1..18: mol_type = other DNA
agtctgagtgctgcggac

SEQ ID NO: 622 - DNA, 18 bp, synthetic construct
  misc_feature 1..18: note = motif sequence
  source 1..18: mol_type = other DNA
tctgagtgctgcggactc

SEQ ID NO: 623 - DNA, 18 bp, synthetic construct
  misc_feature 1..18: note = motif sequence
  source 1..18: mol_type = other DNA
agtgctgcggactcagca

SEQ ID NO: 624 - DNA, 18 bp, synthetic construct
  misc_feature 1..18: note = motif sequence
  source 1..18: mol_type = other DNA
tgctgcggactcagcaga

SEQ ID NO: 625 - DNA, 18 bp, synthetic construct
  misc_feature 1..18: note = motif sequence
  source 1..18: mol_type = other DNA
gcggactcagcagacccg

SEQ ID NO: 626 - DNA, 18 bp, synthetic construct
  misc_feature 1..18: note = motif sequence
  source 1..18: mol_type = other DNA
ggactcagcagacccggc

SEQ ID NO: 627 - DNA, 18 bp, synthetic construct
  misc_feature 1..18: note = motif sequence
  source 1..18: mol_type = other DNA
tcagcagacccggccacc

SEQ ID NO: 628 - DNA, 18 bp, synthetic construct
  misc_feature 1..18: note = motif sequence
  source 1..18: mol_type = other DNA
gtgtcacacgccacttag

SEQ ID NO: 629 - DNA, 18 bp, synthetic construct
  misc_feature 1..18: note = motif sequence
  source 1..18: mol_type = other DNA
gtcacacgccacttaggc

SEQ ID NO: 630 - DNA, 18 bp, synthetic construct
  misc_feature 1..18: note = motif sequence
  source 1..18: mol_type = other DNA
cacacgccacttaggcta

SEQ ID NO: 631 - DNA, 18 bp, synthetic construct
  misc_feature 1..18: note = motif sequence
  source 1..18: mol_type = other DNA
cacgccacttaggctaca

SEQ ID NO: 632 - DNA, 18 bp, synthetic construct
  misc_feature 1..18: note = motif sequence
  source 1..18: mol_type = other DNA
cgccacttaggctacaga

SEQ ID NO: 633 - DNA, 18 bp, synthetic construct
  misc_feature 1..18: note = motif sequence
  source 1..18: mol_type = other DNA
ccacttaggctacagaat

SEQ ID NO: 634 - DNA, 18 bp, synthetic construct
  misc_feature 1..18: note = motif sequence
  source 1..18: mol_type = other DNA
acttaggctacagaataa

SEQ ID NO: 635 - DNA, 18 bp, synthetic construct
  misc_feature 1..18: note = motif sequence
  source 1..18: mol_type = other DNA
ttaggctacagaataagc

SEQ ID NO: 636 - DNA, 18 bp, synthetic construct
  misc_feature 1..18: note = motif sequence
  source 1..18: mol_type = other DNA
aggctacagaataagctc

SEQ ID NO: 637 - DNA, 18 bp, synthetic construct
  misc_feature 1..18: note = motif sequence
  source 1..18: mol_type = other DNA
gctacagaataagctcta

SEQ ID NO: 638 - DNA, 18 bp, synthetic construct
  misc_feature 1..18: note = motif sequence
  source 1..18: mol_type = other DNA
tacagaataagctctacc

SEQ ID NO: 639 - DNA, 18 bp, synthetic construct
  misc_feature 1..18: note = motif sequence
  source 1..18: mol_type = other DNA
cagaataagctctacctc

SEQ ID NO: 640 - DNA, 18 bp, synthetic construct
  misc_feature 1..18: note = motif sequence
  source 1..18: mol_type = other DNA
gaataagctctacctcag

SEQ ID NO: 641 - DNA, 18 bp, synthetic construct
  misc_feature 1..18: note = motif sequence
  source 1..18: mol_type = other DNA
ataagctctacctcagaa

SEQ ID NO: 642 - DNA, 18 bp, synthetic construct
  misc_feature 1..18: note = motif sequence
  source 1..18: mol_type = other DNA
aagctctacctcagaatc

SEQ ID NO: 643 - DNA, 18 bp, synthetic construct
  misc_feature 1..18: note = motif sequence
  source 1..18: mol_type = other DNA
gctctacctcagaatctg

SEQ ID NO: 644 - DNA, 18 bp, synthetic construct
  misc_feature 1..18: note = motif sequence
  source 1..18: mol_type = other DNA
tctacctcagaatctgaa

SEQ ID NO: 645 - DNA, 18 bp, synthetic construct
  misc_feature 1..18: note = motif sequence
  source 1..18: mol_type = other DNA
tacctcagaatctgaaga

SEQ ID NO: 646 - DNA, 18 bp, synthetic construct
  misc_feature 1..18: note = motif sequence
  source 1..18: mol_type = other DNA
cctcagaatctgaagagg

SEQ ID NO: 647 - DNA, 18 bp, synthetic construct
  misc_feature 1..18: note = motif sequence
  source 1..18: mol_type = other DNA
tcagaatctgaagaggca

SEQ ID NO: 648 - DNA, 18 bp, synthetic construct
  misc_feature 1..18: note = motif sequence
  source 1..18: mol_type = other DNA
agaatctgaagaggcaac

SEQ ID NO: 649 - DNA, 18 bp, synthetic construct
  misc_feature 1..18: note = motif sequence
  source 1..18: mol_type = other DNA
aatctgaagaggcaacag

SEQ ID NO: 650 - DNA, 18 bp, synthetic construct
  misc_feature 1..18: note = motif sequence
  source 1..18: mol_type = other DNA
tctgaagaggcaacagtg

SEQ ID NO: 651 - DNA, 18 bp, synthetic construct
  misc_feature 1..18: note = motif sequence
  source 1..18: mol_type = other DNA
tgaagaggcaacagtgtc

SEQ ID NO: 652 - DNA, 18 bp, synthetic construct
  misc_feature 1..18: note = motif sequence
  source 1..18: mol_type = other DNA
aagaggcaacagtgtcag

SEQ ID NO: 653 - DNA, 18 bp, synthetic construct
  misc_feature 1..18: note = motif sequence
  source 1..18: mol_type = other DNA
gaggcaacagtgtcagag

SEQ ID NO: 654 - DNA, 18 bp, synthetic construct
  misc_feature 1..18: note = motif sequence
  source 1..18: mol_type = other DNA
ggcaacagtgtcagagtc

SEQ ID NO: 655 - DNA, 18 bp, synthetic construct
  misc_feature 1..18: note = motif sequence
  source 1..18: mol_type = other DNA
caacagtgtcagagtcca

SEQ ID NO: 656 - DNA, 18 bp, synthetic construct
  misc_feature 1..18: note = motif sequence
  source 1..18: mol_type = other DNA
acagtgtcagagtccatg

SEQ ID NO: 657 - DNA, 18 bp, synthetic construct
  misc_feature 1..18: note = motif sequence
  source 1..18: mol_type = other DNA
agtgtcagagtccatggg

SEQ ID NO: 658 - DNA, 18 bp, synthetic construct
  misc_feature 1..18: note = motif sequence
  source 1..18: mol_type = other DNA
tgtcagagtccatgggaa

SEQ ID NO: 659 - DNA, 18 bp, synthetic construct
  misc_feature 1..18: note = motif sequence
  source 1..18: mol_type = other DNA
tcagagtccatgggaaga

SEQ ID NO: 660 - DNA, 18 bp, synthetic construct
  misc_feature 1..18: note = motif sequence
  source 1..18: mol_type = other DNA
agagtccatgggaagatg

SEQ ID NO: 661 - DNA, 18 bp, synthetic construct
  misc_feature 1..18: note = motif sequence
  source 1..18: mol_type = other DNA
agtccatgggaagatgtt

SEQ ID NO: 662 - DNA, 18 bp, synthetic construct
  misc_feature 1..18: note = motif sequence
  source 1..18: mol_type = other DNA
tgctgcagaggtgcacat

SEQ ID NO: 663 - DNA, 18 bp, synthetic construct
  misc_feature 1..18: note = motif sequence
  source 1..18: mol_type = other DNA
ctgcagaggtgcacatag

SEQ ID NO: 664 - DNA, 18 bp, synthetic construct
  misc_feature 1..18: note = motif sequence
  source 1..18: mol_type = other DNA
gcagaggtgcacatagtc

SEQ ID NO: 665 - DNA, 18 bp, synthetic construct
  misc_feature 1..18: note = motif sequence
  source 1..18: mol_type = other DNA
agaggtgcacatagtctg

SEQ ID NO: 666 - DNA, 18 bp, synthetic construct
  misc_feature 1..18: note = motif sequence
  source 1..18: mol_type = other DNA
aggtgcacatagtctgag

SEQ ID NO: 667 - DNA, 18 bp, synthetic construct
  misc_feature 1..18: note = motif sequence
  source 1..18: mol_type = other DNA
gtgcacatagtctgagtg

SEQ ID NO: 668 - DNA, 18 bp, synthetic construct
  misc_feature 1..18: note = motif sequence
  source 1..18: mol_type = other DNA
gcacatagtctgagtgct

SEQ ID NO: 669 - DNA, 18 bp, synthetic construct
  misc_feature 1..18: note = motif sequence
  source 1..18: mol_type = other DNA
acatagtctgagtgctgc

SEQ ID NO: 670 - DNA, 18 bp, synthetic construct
  misc_feature 1..18: note = motif sequence
  source 1..18: mol_type = other DNA
atagtctgagtgctgcgg

SEQ ID NO: 671 - DNA, 18 bp, synthetic construct
  misc_feature 1..18: note = motif sequence
  source 1..18: mol_type = other DNA
agcagacccggccaccag

SEQ ID NO: 672 - DNA, 18 bp, synthetic construct
  misc_feature 1..18: note = motif sequence
  source 1..18: mol_type = other DNA
cagacccggccaccagcc

SEQ ID NO: 673 - DNA, 18 bp, synthetic construct
  misc_feature 1..18: note = motif sequence
  source 1..18: mol_type = other DNA
gacccggccaccagcctt

SEQ ID NO: 674 - DNA, 18 bp, synthetic construct
  misc_feature 1..18: note = motif sequence
  source 1..18: mol_type = other DNA
cccggccaccagccttac

SEQ ID NO: 675 - DNA, 18 bp, synthetic construct
  misc_feature 1..18: note = motif sequence
  source 1..18: mol_type = other DNA
cggccaccagccttactc

SEQ ID NO: 676 - DNA, 18 bp, synthetic construct
  misc_feature 1..18: note = motif sequence
  source 1..18: mol_type = other DNA
gccaccagccttactcca

SEQ ID NO: 677 - DNA, 18 bp, synthetic construct
  misc_feature 1..18: note = motif sequence
  source 1..18: mol_type = other DNA
caccagccttactccact

SEQ ID NO: 678 - DNA, 18 bp, synthetic construct
  misc_feature 1..18: note = motif sequence
  source 1..18: mol_type = other DNA
ccagccttactccactcc

SEQ ID NO: 679 - DNA, 18 bp, synthetic construct
  misc_feature 1..18: note = motif sequence
  source 1..18: mol_type = other DNA
agccttactccactcccc

SEQ ID NO: 680 - DNA, 18 bp, synthetic construct
  misc_feature 1..18: note = motif sequence
  source 1..18: mol_type = other DNA
ccttactccactcccctg

SEQ ID NO: 681 - DNA, 18 bp, synthetic construct
  misc_feature 1..18: note = motif sequence
  source 1..18: mol_type = other DNA
ttactccactcccctgga

SEQ ID NO: 682 - DNA, 18 bp, synthetic construct
  misc_feature 1..18: note = motif sequence
  source 1..18: mol_type = other DNA
actccactcccctggaag

SEQ ID NO: 683 - DNA, 18 bp, synthetic construct
  misc_feature 1..18: note = motif sequence
  source 1..18: mol_type = other DNA
tccactcccctggaagga

SEQ ID NO: 684 - DNA, 18 bp, synthetic construct
  misc_feature 1..18: note = motif sequence
  source 1..18: mol_type = other DNA
cactcccctggaaggaaa

SEQ ID NO: 685 - DNA, 18 bp, synthetic construct
  misc_feature 1..18: note = motif sequence
  source 1..18: mol_type = other DNA
ctcccctggaaggaaaga

SEQ ID NO: 686 - DNA, 18 bp, synthetic construct
  misc_feature 1..18: note = motif sequence
  source 1..18: mol_type = other DNA
cccctggaaggaaagacc

SEQ ID NO: 687 - DNA, 18 bp, synthetic construct
  misc_feature 1..18: note = motif sequence
  source 1..18: mol_type = other DNA
cctggaaggaaagaccac

SEQ ID NO: 688 - DNA, 18 bp, synthetic construct
  misc_feature 1..18: note = motif sequence
  source 1..18: mol_type = other DNA
tggaaggaaagaccacag

SEQ ID NO: 689 - DNA, 18 bp, synthetic construct
  misc_feature 1..18: note = motif sequence
  source 1..18: mol_type = other DNA
gaaggaaagaccacagtg

SEQ ID NO: 690 - DNA, 18 bp, synthetic construct
  misc_feature 1..18: note = motif sequence
  source 1..18: mol_type = other DNA
aggaaagaccacagtgag

SEQ ID NO: 691 - DNA, 18 bp, synthetic construct
  misc_feature 1..18: note = motif sequence
  source 1..18: mol_type = other DNA
gaaagaccacagtgagta

SEQ ID NO: 692 - DNA, 18 bp, synthetic construct
  misc_feature 1..18: note = motif sequence
  source 1..18: mol_type = other DNA
aagaccacagtgagtaaa

SEQ ID NO: 693 - DNA, 18 bp, synthetic construct
  misc_feature 1..18: note = motif sequence
  source 1..18: mol_type = other DNA
gaccacagtgagtaaaag

SEQ ID NO: 694 - DNA, 18 bp, synthetic construct
  misc_feature 1..18: note = motif sequence
  source 1..18: mol_type = other DNA
ccacagtgagtaaaagtt

SEQ ID NO: 695 - DNA, 18 bp, synthetic construct
  misc_feature 1..18: note = motif sequence
  source 1..18: mol_type = other DNA
acagtgagtaaaagttgc

SEQ ID NO: 696 - DNA, 18 bp, synthetic construct
  misc_feature 1..18: note = motif sequence
  source 1..18: mol_type = other DNA
agtgagtaaaagttgcca

SEQ ID NO: 697 - DNA, 18 bp, synthetic construct
  misc_feature 1..18: note = motif sequence
  source 1..18: mol_type = other DNA
tgagtaaaagttgccaag

SEQ ID NO: 698 - DNA, 18 bp, synthetic construct
  misc_feature 1..18: note = motif sequence
  source 1..18: mol_type = other DNA
agtaaaagttgccaagga

SEQ ID NO: 699 - DNA, 18 bp, synthetic construct
  misc_feature 1..18: note = target site sequence
  source 1..18: mol_type = other DNA
agaacatcttcccatgga

SEQ ID NO: 700 - DNA, 18 bp, synthetic construct
  misc_feature 1..18: note = target site sequence
  source 1..18: mol_type = other DNA
ctccccagaacatcttcc

SEQ ID NO: 701 - DNA, 18 bp, synthetic construct
  misc_feature 1..18: note = target site sequence
  source 1..18: mol_type = other DNA
tgtcacctccccagaaca

SEQ ID NO: 702 - DNA, 18 bp, synthetic construct
  misc_feature 1..18: note = target site sequence
  source 1..18: mol_type = other DNA
cccagttgtcacctcccc

SEQ ID NO: 703 - DNA, 18 bp, synthetic construct
  misc_feature 1..18: note = target site sequence
  source 1..18: mol_type = other DNA
tgcaggcccagttgtcac

SEQ ID NO: 704 - DNA, 18 bp, synthetic construct
  misc_feature 1..18: note = target site sequence
  source 1..18: mol_type = other DNA
agcaggtgcaggcccagt

SEQ ID NO: 705 - DNA, 18 bp, synthetic construct
  misc_feature 1..18: note = target site sequence
  source 1..18: mol_type = other DNA
ctctgcagcaggtgcagg

SEQ ID NO: 706 - DNA, 18 bp, synthetic construct
  misc_feature 1..18: note = target site sequence
  source 1..18: mol_type = other DNA
gtgcacctctgcagcagg

SEQ ID NO: 707 - DNA, 18 bp, synthetic construct
  misc_feature 1..18: note = target site sequence
  source 1..18: mol_type = other DNA
ctgagtccgcagcactca

SEQ ID NO: 708 - DNA, 18 bp, synthetic construct
  misc_feature 1..18: note = target site sequence
  source 1..18: mol_type = other DNA
ggtctgctgagtccgcag

SEQ ID NO: 709 - DNA, 18 bp, synthetic construct
  misc_feature 1..18: note = target site sequence
  source 1..18: mol_type = other DNA
tggccgggtctgctgagt

SEQ ID NO: 710 - DNA, 18 bp, synthetic construct
  misc_feature 1..18: note = target site sequence
  source 1..18: mol_type = other DNA
ccagaacatcttcccatg

SEQ ID NO: 711 - DNA, 18 bp, synthetic construct
  misc_feature 1..18: note = target site sequence
  source 1..18: mol_type = other DNA
ccccagaacatcttccca

SEQ ID NO: 712 - DNA, 18 bp, synthetic construct
  misc_feature 1..18: note = target site sequence
  source 1..18: mol_type = other DNA
acctccccagaacatctt

SEQ ID NO: 713 - DNA, 18 bp, synthetic construct
  misc_feature 1..18: note = target site sequence
  source 1..18: mol_type = other DNA
tcacctccccagaacatc

SEQ ID NO: 714 - DNA, 18 bp, synthetic construct
  misc_feature 1..18: note = target site sequence
  source 1..18: mol_type = other DNA
gttgtcacctccccagaa

SEQ ID NO: 715 - DNA, 18 bp, synthetic construct
  misc_feature 1..18: note = target site sequence
  source 1..18: mol_type = other DNA
cagttgtcacctccccag

SEQ ID NO: 716 - DNA, 18 bp, synthetic construct
  misc_feature 1..18: note = target site sequence
  source 1..18: mol_type = other DNA
ggcccagttgtcacctcc

SEQ ID NO: 717 - DNA, 18 bp, synthetic construct
  misc_feature 1..18: note = target site sequence
  source 1..18: mol_type = other DNA
caggcccagttgtcacct

SEQ ID NO: 718 - DNA, 18 bp, synthetic construct
  misc_feature 1..18: note = target site sequence
  source 1..18: mol_type = other DNA
ggtgcaggcccagttgtc

SEQ ID NO: 719 - DNA, 18 bp, synthetic construct
  misc_feature 1..18: note = target site sequence
  source 1..18: mol_type = other DNA
caggtgcaggcccagttg

SEQ ID NO: 720 - DNA, 18 bp, synthetic construct
  misc_feature 1..18: note = target site sequence
  source 1..18: mol_type = other DNA
gcagcaggtgcaggccca

SEQ ID NO: 721 - DNA, 18 bp, synthetic construct
  misc_feature 1..18: note = target site sequence
  source 1..18: mol_type = other DNA
ctgcagcaggtgcaggcc

SEQ ID NO: 722 - DNA, 18 bp, synthetic construct
  misc_feature 1..18: note = target site sequence
  source 1..18: mol_type = other DNA
gcacctctgcagcaggtg

SEQ ID NO: 723 - DNA, 18 bp, synthetic construct
  misc_feature 1..18: note = target site sequence
  source 1..18: mol_type = other DNA
gtccgcagcactcagact

SEQ ID NO: 724 - DNA, 18 bp, synthetic construct
  misc_feature 1..18: note = target site sequence
  source 1..18: mol_type = other DNA
gagtccgcagcactcaga

SEQ ID NO: 725 - DNA, 18 bp, synthetic construct
  misc_feature 1..18: note = target site sequence
  source 1..18: mol_type = other DNA
tgctgagtccgcagcact

SEQ ID NO: 726 - DNA, 18 bp, synthetic construct
  misc_feature 1..18: note = target site sequence
  source 1..18: mol_type = other DNA
tctgctgagtccgcagca

SEQ ID NO: 727 - DNA, 18 bp, synthetic construct
  misc_feature 1..18: note = target site sequence
  source 1..18: mol_type = other DNA
cgggtctgctgagtccgc

SEQ ID NO: 728 - DNA, 18 bp, synthetic construct
  misc_feature 1..18: note = target site sequence
  source 1..18: mol_type = other DNA
gccgggtctgctgagtcc

SEQ ID NO: 729 - DNA, 18 bp, synthetic construct
  misc_feature 1..18: note = target site sequence
  source 1..18: mol_type = other DNA
ggtggccgggtctgctga

SEQ ID NO: 730 - DNA, 18 bp, synthetic construct
  misc_feature 1..18: note = target site sequence
  source 1..18: mol_type = other DNA
ctaagtggcgtgtgacac

SEQ ID NO: 731 - DNA, 18 bp, synthetic construct
  misc_feature 1..18: note = target site sequence
  source 1..18: mol_type = other DNA
gcctaagtggcgtgtgac

SEQ ID NO: 732 - DNA, 18 bp, synthetic construct
  misc_feature 1..18: note = target site sequence
  source 1..18: mol_type = other DNA
tagcctaagtggcgtgtg

SEQ ID NO: 733 - DNA, 18 bp, synthetic construct
  misc_feature 1..18: note = target site sequence
  source 1..18: mol_type = other DNA
tgtagcctaagtggcgtg

SEQ ID NO: 734 - DNA, 18 bp, synthetic construct
  misc_feature 1..18: note = target site sequence
  source 1..18: mol_type = other DNA
tctgtagcctaagtggcg

SEQ ID NO: 735 - DNA, 18 bp, synthetic construct
  misc_feature 1..18: note = target site sequence
  source 1..18: mol_type = other DNA
attctgtagcctaagtgg

SEQ ID NO: 736 - DNA, 18 bp, synthetic construct
  misc_feature 1..18: note = target site sequence
  source 1..18: mol_type = other DNA
ttattctgtagcctaagt

SEQ ID NO: 737 - DNA, 18 bp, synthetic construct
  misc_feature 1..18: note = target site sequence
  source 1..18: mol_type = other DNA
gcttattctgtagcctaa

SEQ ID NO: 738 - DNA, 18 bp, synthetic construct
  misc_feature 1..18: note = target site sequence
  source 1..18: mol_type = other DNA
gagcttattctgtagcct

SEQ ID NO: 739 - DNA, 18 bp, synthetic construct
  misc_feature 1..18: note = target site sequence
  source 1..18: mol_type = other DNA
tagagcttattctgtagc

SEQ ID NO: 740 - DNA, 18 bp, synthetic construct
  misc_feature 1..18: note = target site sequence
  source 1..18: mol_type = other DNA
ggtagagcttattctgta

SEQ ID NO: 741 - DNA, 18 bp, synthetic construct
  misc_feature 1..18: note = target site sequence
  source 1..18: mol_type = other DNA
gaggtagagcttattctg

SEQ ID NO: 742 - DNA, 18 bp, synthetic construct
  misc_feature 1..18: note = target site sequence
  source 1..18: mol_type = other DNA
ctgaggtagagcttattc

SEQ ID NO: 743 - DNA, 18 bp, synthetic construct
  misc_feature 1..18: note = target site sequence
  source 1..18: mol_type = other DNA
ttctgaggtagagcttat

SEQ ID NO: 744 - DNA, 18 bp, synthetic construct
  misc_feature 1..18: note = target site sequence
  source 1..18: mol_type = other DNA
gattctgaggtagagctt

SEQ ID NO: 745 - DNA, 18 bp, synthetic construct
  misc_feature 1..18: note = target site sequence
  source 1..18: mol_type = other DNA
cagattctgaggtagagc

SEQ ID NO: 746 - DNA, 18 bp, synthetic construct
  misc_feature 1..18: note = target site sequence
  source 1..18: mol_type = other DNA
ttcagattctgaggtaga

SEQ ID NO: 747 - DNA, 18 bp, synthetic construct
  misc_feature 1..18: note = target site sequence
  source 1..18: mol_type = other DNA
tcttcagattctgaggta

SEQ ID NO: 748 - DNA, 18 bp, synthetic construct
  misc_feature 1..18: note = target site sequence
  source 1..18: mol_type = other DNA
cctcttcagattctgagg

SEQ ID NO: 749 - DNA, 18 bp, synthetic construct
  misc_feature 1..18: note = target site sequence
  source 1..18: mol_type = other DNA
tgcctcttcagattctga

SEQ ID NO: 750 - DNA, 18 bp, synthetic construct
  misc_feature 1..18: note = target site sequence
  source 1..18: mol_type = other DNA
gttgcctcttcagattct

SEQ ID NO: 751 - DNA, 18 bp, synthetic construct
  misc_feature 1..18: note = target site sequence
  source 1..18: mol_type = other DNA
ctgttgcctcttcagatt

SEQ ID NO: 752 - DNA, 18 bp, synthetic construct
  misc_feature 1..18: note = target site sequence
  source 1..18: mol_type = other DNA
cactgttgcctcttcaga

SEQ ID NO: 753 - DNA, 18 bp, synthetic construct
  misc_feature 1..18: note = target site sequence
  source 1..18: mol_type = other DNA
gacactgttgcctcttca

SEQ ID NO: 754 - DNA, 18 bp, synthetic construct
  misc_feature 1..18: note = target site sequence
  source 1..18: mol_type = other DNA
ctgacactgttgcctctt

SEQ ID NO: 755 - DNA, 18 bp, synthetic construct
  misc_feature 1..18: note = target site sequence
  source 1..18: mol_type = other DNA
ctctgacactgttgcctc

SEQ ID NO: 756 - DNA, 18 bp, synthetic construct
  misc_feature 1..18: note = target site sequence
  source 1..18: mol_type = other DNA
gactctgacactgttgcc

SEQ ID NO: 757 - DNA, 18 bp, synthetic construct
  misc_feature 1..18: note = target site sequence
  source 1..18: mol_type = other DNA
tggactctgacactgttg

SEQ ID NO: 758 - DNA, 18 bp, synthetic construct
  misc_feature 1..18: note = target site sequence
  source 1..18: mol_type = other DNA
catggactctgacactgt

SEQ ID NO: 759 - DNA, 18 bp, synthetic construct
  misc_feature 1..18: note = target site sequence
  source 1..18: mol_type = other DNA
cccatggactctgacact

SEQ ID NO: 760 - DNA, 18 bp, synthetic construct
  misc_feature 1..18: note = target site sequence
  source 1..18: mol_type = other DNA
ttcccatggactctgaca

SEQ ID NO: 761 - DNA, 18 bp, synthetic construct
  misc_feature 1..18: note = target site sequence
  source 1..18: mol_type = other DNA
tcttcccatggactctga

SEQ ID NO: 762 - DNA, 18 bp, synthetic construct
  misc_feature 1..18: note = target site sequence
  source 1..18: mol_type = other DNA
catcttcccatggactct

SEQ ID NO: 763 - DNA, 18 bp, synthetic construct
  misc_feature 1..18: note = target site sequence
  source 1..18: mol_type = other DNA
aacatcttcccatggact

SEQ ID NO: 764 - DNA, 18 bp, synthetic construct
  misc_feature 1..18: note = target site sequence
  source 1..18: mol_type = other DNA
atgtgcacctctgcagca

SEQ ID NO: 765 - DNA, 18 bp, synthetic construct
  misc_feature 1..18: note = target site sequence
  source 1..18: mol_type = other DNA
ctatgtgcacctctgcag

SEQ ID NO: 766 - DNA, 18 bp, synthetic construct
  misc_feature 1..18: note = target site sequence
  source 1..18: mol_type = other DNA
gactatgtgcacctctgc

SEQ ID NO: 767 - DNA, 18 bp, synthetic construct
  misc_feature 1..18: note = target site sequence
  source 1..18: mol_type = other DNA
cagactatgtgcacctct

SEQ ID NO: 768 - DNA, 18 bp, synthetic construct
  misc_feature 1..18: note = target site sequence
  source 1..18: mol_type = other DNA
ctcagactatgtgcacct

SEQ ID NO: 769 - DNA, 18 bp, synthetic construct
  misc_feature 1..18: note = target site sequence
  source 1..18: mol_type = other DNA
cactcagactatgtgcac

SEQ ID NO: 770 - DNA, 18 bp, synthetic construct
  misc_feature 1..18: note = target site sequence
  source 1..18: mol_type = other DNA
agcactcagactatgtgc

SEQ ID NO: 771 - DNA, 18 bp, synthetic construct
  misc_feature 1..18: note = target site sequence
  source 1..18: mol_type = other DNA
gcagcactcagactatgt

SEQ ID NO: 772 - DNA, 18 bp, synthetic construct
  misc_feature 1..18: note = target site sequence
  source 1..18: mol_type = other DNA
ccgcagcactcagactat

SEQ ID NO: 773 - DNA, 18 bp, synthetic construct
  misc_feature 1..18: note = target site sequence
  source 1..18: mol_type = other DNA
ctggtggccgggtctgct

SEQ ID NO: 774 - DNA, 18 bp, synthetic construct
  misc_feature 1..18: note = target site sequence
  source 1..18: mol_type = other DNA
ggctggtggccgggtctg

SEQ ID NO: 775 - DNA, 18 bp, synthetic construct
  misc_feature 1..18: note = target site sequence
  source 1..18: mol_type = other DNA
aaggctggtggccgggtc

SEQ ID NO: 776 - DNA, 18 bp, synthetic construct
  misc_feature 1..18: note = target site sequence
  source 1..18: mol_type = other DNA
gtaaggctggtggccggg

SEQ ID NO: 777 - DNA, 18 bp, synthetic construct
  misc_feature 1..18: note = target site sequence
  source 1..18: mol_type = other DNA
gagtaaggctggtggccg

SEQ ID NO: 778 - DNA, 18 bp, synthetic construct
  misc_feature 1..18: note = target site sequence
  source 1..18: mol_type = other DNA
tggagtaaggctggtggc

SEQ ID NO: 779 - DNA, 18 bp, synthetic construct
  misc_feature 1..18: note = target site sequence
  source 1..18: mol_type = other DNA
agtggagtaaggctggtg

SEQ ID NO: 780 - DNA, 18 bp, synthetic construct
  misc_feature 1..18: note = target site sequence
  source 1..18: mol_type = other DNA
ggagtggagtaaggctgg

SEQ ID NO: 781 - DNA, 18 bp, synthetic construct
  misc_feature 1..18: note = target site sequence
  source 1..18: mol_type = other DNA
ggggagtggagtaaggct

SEQ ID NO: 782 - DNA, 18 bp, synthetic construct
  misc_feature 1..18: note = target site sequence
  source 1..18: mol_type = other DNA
caggggagtggagtaagg

SEQ ID NO: 783 - DNA, 18 bp, synthetic construct
  misc_feature 1..18: note = target site sequence
  source 1..18: mol_type = other DNA
tccaggggagtggagtaa

SEQ ID NO: 784 - DNA, 18 bp, synthetic construct
  misc_feature 1..18: note = target site sequence
  source 1..18: mol_type = other DNA
cttccaggggagtggagt

SEQ ID NO: 785 - DNA, 18 bp, synthetic construct
  misc_feature 1..18: note = target site sequence
  source 1..18: mol_type = other DNA
tccttccaggggagtgga

SEQ ID NO: 786 - DNA, 18 bp, synthetic construct
  misc_feature 1..18: note = target site sequence
  source 1..18: mol_type = other DNA
tttccttccaggggagtg

SEQ ID NO: 787 - DNA, 18 bp, synthetic construct
  misc_feature 1..18: note = target site sequence
  source 1..18: mol_type = other DNA
tctttccttccaggggag

SEQ ID NO: 788 - DNA, 18 bp, synthetic construct
  misc_feature 1..18: note = target site sequence
  source 1..18: mol_type = other DNA
ggtctttccttccagggg

SEQ ID NO: 789 - DNA, 18 bp, synthetic construct
  misc_feature 1..18: note = target site sequence
  source 1..18: mol_type = other DNA
gtggtctttccttccagg

SEQ ID NO: 790 - DNA, 18 bp, synthetic construct
  misc_feature 1..18: note = target site sequence
  source 1..18: mol_type = other DNA
ctgtggtctttccttcca

SEQ ID NO: 791 - DNA, 18 bp, synthetic construct
  misc_feature 1..18: note = target site sequence
  source 1..18: mol_type = other DNA
cactgtggtctttccttc

SEQ ID NO: 792 - DNA, 18 bp, synthetic construct
  misc_feature 1..18: note = target site sequence
  source 1..18: mol_type = other DNA
ctcactgtggtctttcct

SEQ ID NO: 793 - DNA, 18 bp, synthetic construct
  misc_feature 1..18: note = target site sequence
  source 1..18: mol_type = other DNA
tactcactgtggtctttc

SEQ ID NO: 794 - DNA, 18 bp, synthetic construct
  misc_feature 1..18: note = target site sequence
  source 1..18: mol_type = other DNA
tttactcactgtggtctt

SEQ ID NO: 795 - DNA, 18 bp, synthetic construct
  misc_feature 1..18: note = target site sequence
  source 1..18: mol_type = other DNA
cttttactcactgtggtc

SEQ ID NO: 796 - DNA, 18 bp, synthetic construct
  misc_feature 1..18: note = target site sequence
  source 1..18: mol_type = other DNA
aacttttactcactgtgg

SEQ ID NO: 797 - DNA, 18 bp, synthetic construct
  misc_feature 1..18: note = target site sequence
  source 1..18: mol_type = other DNA
gcaacttttactcactgt

SEQ ID NO: 798 - DNA, 18 bp, synthetic construct
  misc_feature 1..18: note = target site sequence
  source 1..18: mol_type = other DNA
tggcaacttttactcact

SEQ ID NO: 799 - DNA, 18 bp, synthetic construct
  misc_feature 1..18: note = target site sequence
  source 1..18: mol_type = other DNA
cttggcaacttttactca

SEQ ID NO: 800 - DNA, 18 bp, synthetic construct
  misc_feature 1..18: note = target site sequence
  source 1..18: mol_type = other DNA
tccttggcaacttttact

SEQ ID NO: 801 - DNA, 6010 bp, Homo sapiens
  source 1..6010: mol_type = genomic DNA
gctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggtgggcgaggggccggggtctggggccagatctgaagccgggactagggacaggggcaggggcaggggctgggagcggggacccagcactggccgccccgcagggctccgtcgcctttggcctggcgggtcggtgccagcgtggcgcggggcggggcaggaagcccggactgaccggatccgccacgctgggaacctagggcggcccagggctcttttctgtactttttaactctctcgttagagatgaccagagctggggatgcgggcacctgtcttccaggccctcttgctgtgtggccgcagactggtggttcagcctcttaactcggacatgaggtcgaataatctgttttggtttactgctatttctggagaggcgcggagctgaaataacagagctgttgaaagggctgggaattctgcgaggctcactggtctagctcagtatctgcgttcttaaaatggaacctacttcatgaggtctttggggagattgagacttggatataatgtgcctagcacttagtcctccgtaaatgttcactcttttgtgatcattgtgccttctgtgatttatgaagtgtctcttctgagttaattcttttaaaaaaaaaagtgtctcctccaacagacacggacccatcagcaggtcactgcctaggatctcaacactagagatcagggagtggcatcagcctctcccttttctaaattggactgggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagactgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgcctgtaatcccagcactttgggagcctgagttgggcagatcacttgaagccagcagtttgagaccagcctagccaacatggtaaaatcccgtctctacccaaaaatataccaaaaaaaaaaaaaaaaaaaaggccaagcgtgagtgcctgtagtcccagctactcgggaggttgaggtgggaggattgtttgaacctgggagagggaggttgcagtgagctgagatcgcaccactgcactccagcctgggcaacagagtgagactctgtctcaagaaaaaaaaaaaaagtttgctgggcaccggggctcacacctgtaatcccagcactttgggaggccaaggtgggtagataacttgagatcaggagttcgagaccagcctgaccaacgtggtgaaaccccatctctattaaaaatacaaaaattagccgggtgtcgtggcaggcacctgtaatcccagctgctccggaggctgacgcaggagaatcacttgaacccaggaggcggaggttgcagtgagctgagatcacgagatcatgccactgcactccagtctgggcgacagagcaaaaaccctgtctcaaaaaaaaaaaaaaagttaatctaagttaggacagagagttggtgaagtggtgaagcttgttgagggcagaagtgattgactttgtggcatttggtgctagatgtatctcaaagtagatggatttaacaatgtttattgagtttgtagtaagaaattagcaagggctaataggaaataattgcttaaactttacattcttcctggcatggccagaaattcactaaaggttcctttccccctctagggtccacctgttaatcaatcttaaattgttgccaattacacatcttgaatacatagagattatttatattgtttttttaaccccttggtcaatttgcatatattgagctttttaaagttttaatcattagttggttcttctaagaatcatgagtcaggagcagggattttttttaacttattttggatttatagtcaccactaccacttttattattacctgccagttcaagatagttatttatttttattttatattattattattattattatcatcatcattattttgagatggagtctcactctgttgcccaggctggagtgcagtggtgcaatctcggctcactgcaacctctgcctcccaggttcaagcaattctccctgcttcagcctccagattagctgggattacaggcacccctcaccacatccagctaatttttggattttttagtagagatgggggtttgccatgttggccaggctggttttgaactcttgacctcaggtgatccacctgccttggcctcccaaagtgttaggattacaagtgtgagccaccgagcctggccaagatagtttaaaaaaaaaattatatctacattaaagccacaagtcaccctttgctgaagtcagtattagtagttggaagcagtgtgttattcttgaccccatgaagtggcacttattaagtagcttgcttttccataattatggcctagctttttaaaacctactatgaacaccacaagcatagagttttccaaaagttcaagaaggaaaggaaaccaattatactgaatcaggtagattcttaactgaaataattagatgttttaatagcctcttatgaactttcttccagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaacaatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 802 - DNA, 1817 bp, Homo sapiens
  source 1..1817: mol_type = genomic DNA
gctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 803 - protein, 261 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 804 - DNA, 1791 bp, Homo sapiens
  source 1..1791: mol_type = genomic DNA
gctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 805 - protein, 376 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAAGAGPVVTPPEHLPMDSGGIDSSDSESDILLGILDNLDPVMFFKCPSPEPASLEELPEVYPEGPSSLPASLSLSVGTSSAKLEAINELIRFDHIYTKPLVLEIPSETESQANVVVKIEEAPLSPSENDHPEFIVSVKEEPVEDDLVPELGISNLLSSSHCPKPSSCLLDAYSDCGYGGSLSPFSDMSSLLGVNHSWEDTFANELFPQLISV

SEQ ID NO: 806 - DNA, 1671 bp, Homo sapiens
  source 1..1671: mol_type = genomic DNA
gctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 807 - protein, 336 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKSDILLGILDNLDPVMFFKCPSPEPASLEELPEVYPEGPSSLPASLSLSVGTSSAKLEAINELIRFDHIYTKPLVLEIPSETESQANVVVKIEEAPLSPSENDHPEFIVSVKEEPVEDDLVPELGISNLLSSSHCPKPSSCLLDAYSDCGYGGSLSPFSDMSSLLGVNHSWEDTFANELFPQLISV

SEQ ID NO: 808 - DNA, 18 bp, synthetic construct
  misc_feature 1..18: note = motif sequence
  source 1..18: mol_type = other DNA
acaactgggcctgcacct

SEQ ID NO: 809 - DNA, 18 bp, synthetic construct
  misc_feature 1..18: note = motif sequence
  source 1..18: mol_type = other DNA
gggcctgcacctgctgca

SEQ ID NO: 810 - DNA, 18 bp, synthetic construct
  misc_feature 1..18: note = motif sequence
  source 1..18: mol_type = other DNA
gcacctgctgcagaggtg

SEQ ID NO: 811 - DNA, 18 bp, synthetic construct
  misc_feature 1..18: note = motif sequence
  source 1..18: mol_type = other DNA
gaggtgcacgtagtctga

SEQ ID NO: 812 - DNA, 18 bp, synthetic construct
  misc_feature 1..18: note = motif sequence
  source 1..18: mol_type = other DNA
cacgtagtctgagtgctg

SEQ ID NO: 813 - DNA, 18 bp, synthetic construct
  misc_feature 1..18: note = motif sequence
  source 1..18: mol_type = other DNA
gtctgagtgctgcggact

SEQ ID NO: 814 - DNA, 18 bp, synthetic construct
  misc_feature 1..18: note = motif sequence
  source 1..18: mol_type = other DNA
gtgctgcggactcagcag

SEQ ID NO: 815 - DNA, 18 bp, synthetic construct
  misc_feature 1..18: note = motif sequence
  source 1..18: mol_type = other DNA
cggactcagcagacccgg

SEQ ID NO: 816 - DNA, 18 bp, synthetic construct
  misc_feature 1..18: note = motif sequence
  source 1..18: mol_type = other DNA
ggtgacaactgggcctgc

SEQ ID NO: 817 - DNA, 18 bp, synthetic construct
  misc_feature 1..18: note = motif sequence
  source 1..18: mol_type = other DNA
aactgggcctgcacctgc

SEQ ID NO: 818 - DNA, 18 bp, synthetic construct
  misc_feature 1..18: note = motif sequence
  source 1..18: mol_type = other DNA
ctgcacctgctgcagagg

SEQ ID NO: 819 - DNA, 18 bp, synthetic construct
  misc_feature 1..18: note = motif sequence
  source 1..18: mol_type = other DNA
ctgctgcagaggtgcacg

SEQ ID NO: 820 - DNA, 18 bp, synthetic construct
  misc_feature 1..18: note = motif sequence
  source 1..18: mol_type = other DNA
tgcagaggtgcacgtagt

SEQ ID NO: 821 - DNA, 18 bp, synthetic construct
  misc_feature 1..18: note = motif sequence
  source 1..18: mol_type = other DNA
cagaggtgcacgtagtct

SEQ ID NO: 822 - DNA, 18 bp, synthetic construct
  misc_feature 1..18: note = motif sequence
  source 1..18: mol_type = other DNA
ggtgcacgtagtctgagt

SEQ ID NO: 823 - DNA, 18 bp, synthetic construct
  misc_feature 1..18: note = motif sequence
  source 1..18: mol_type = other DNA
tgcacgtagtctgagtgc

SEQ ID NO: 824 - DNA, 18 bp, synthetic construct
  misc_feature 1..18: note = motif sequence
  source 1..18: mol_type = other DNA
cgtagtctgagtgctgcg

SEQ ID NO: 825 - DNA, 18 bp, synthetic construct
  misc_feature 1..18: note = motif sequence
  source 1..18: mol_type = other DNA
tagtctgagtgctgcgga

SEQ ID NO: 826 - DNA, 18 bp, synthetic construct
  misc_feature 1..18: note = motif sequence
  source 1..18: mol_type = other DNA
ctgagtgctgcggactca

SEQ ID NO: 827 - DNA, 18 bp, synthetic construct
  misc_feature 1..18: note = motif sequence
  source 1..18: mol_type = other DNA
gagtgctgcggactcagc

SEQ ID NO: 828 - DNA, 18 bp, synthetic construct
  misc_feature 1..18: note = motif sequence
  source 1..18: mol_type = other DNA
gctgcggactcagcagac

SEQ ID NO: 829 - DNA, 18 bp, synthetic construct
  misc_feature 1..18: note = motif sequence
  source 1..18: mol_type = other DNA
tgcggactcagcagaccc

SEQ ID NO: 830 - DNA, 18 bp, synthetic construct
  misc_feature 1..18: note = motif sequence
  source 1..18: mol_type = other DNA
gactcagcagacccggcc

SEQ ID NO: 831 - DNA, 18 bp, synthetic construct
  misc_feature 1..18: note = motif sequence
  source 1..18: mol_type = other DNA
ctcagcagacccggccac

SEQ ID NO: 832 - DNA, 18 bp, synthetic construct
  misc_feature 1..18: note = motif sequence
  source 1..18: mol_type = other DNA
ctggttatatagctcttt

SEQ ID NO: 833 - DNA, 18 bp, synthetic construct
  misc_feature 1..18: note = motif sequence
  source 1..18: mol_type = other DNA
ggttatatagctctttaa

SEQ ID NO: 834 - DNA, 18 bp, synthetic construct
  misc_feature 1..18: note = motif sequence
  source 1..18: mol_type = other DNA
ttatatagctctttaata

SEQ ID NO: 835 - DNA, 18 bp, synthetic construct
  misc_feature 1..18: note = motif sequence
  source 1..18: mol_type = other DNA
atatagctctttaataag

SEQ ID NO: 836 - DNA, 18 bp, synthetic construct
  misc_feature 1..18: note = motif sequence
  source 1..18: mol_type = other DNA
atagctctttaataagtc

SEQ ID NO: 837 - DNA, 18 bp, synthetic construct
  misc_feature 1..18: note = motif sequence
  source 1..18: mol_type = other DNA
agctctttaataagtcag

SEQ ID NO: 838 - DNA, 18 bp, synthetic construct
  misc_feature 1..18: note = motif sequence
  source 1..18: mol_type = other DNA
ctctttaataagtcagaa

SEQ ID NO: 839 - DNA, 18 bp, synthetic construct
  misc_feature 1..18: note = motif sequence
  source 1..18: mol_type = other DNA
ctttaataagtcagaatg

SEQ ID NO: 840 - DNA, 18 bp, synthetic construct
  misc_feature 1..18: note = motif sequence
  source 1..18: mol_type = other DNA
ttaataagtcagaatgat

SEQ ID NO: 841 - DNA, 18 bp, synthetic construct
  misc_feature 1..18: note = motif sequence
  source 1..18: mol_type = other DNA
aataagtcagaatgatcc

SEQ ID NO: 842 - DNA, 18 bp, synthetic construct
  misc_feature 1..18: note = motif sequence
  source 1..18: mol_type = other DNA
taagtcagaatgatccct

SEQ ID NO: 843 - DNA, 18 bp, synthetic construct
  misc_feature 1..18: note = motif sequence
  source 1..18: mol_type = other DNA
agtcagaatgatccctac

SEQ ID NO: 844 - DNA, 18 bp, synthetic construct
  misc_feature 1..18: note = motif sequence
  source 1..18: mol_type = other DNA
tcagaatgatccctacct

SEQ ID NO: 845 - DNA, 18 bp, synthetic construct
  misc_feature 1..18: note = motif sequence
  source 1..18: mol_type = other DNA
agaatgatccctacctct

SEQ ID NO: 846 - DNA, 18 bp, synthetic construct
  misc_feature 1..18: note = motif sequence
  source 1..18: mol_type = other DNA
aatgatccctacctctga

SEQ ID NO: 847 - DNA, 18 bp, synthetic construct
  misc_feature 1..18: note = motif sequence
  source 1..18: mol_type = other DNA
atccctacctctgaatct

SEQ ID NO: 848 - DNA, 18 bp, synthetic construct
  misc_feature 1..18: note = motif sequence
  source 1..18: mol_type = other DNA
ccctacctctgaatctga

SEQ ID NO: 849 - DNA, 18 bp, synthetic construct
  misc_feature 1..18: note = motif sequence
  source 1..18: mol_type = other DNA
ctacctctgaatctgaag

SEQ ID NO: 850 - DNA, 18 bp, synthetic construct
  misc_feature 1..18: note = motif sequence
  source 1..18: mol_type = other DNA
acctctgaatctgaagag

SEQ ID NO: 851 - DNA, 18 bp, synthetic construct
  misc_feature 1..18: note = motif sequence
  source 1..18: mol_type = other DNA
ctctgaatctgaagagtc

SEQ ID NO: 852 - DNA, 18 bp, synthetic construct
  misc_feature 1..18: note = motif sequence
  source 1..18: mol_type = other DNA
ctgaatctgaagagtcaa

SEQ ID NO: 853 - DNA, 18 bp, synthetic construct
  misc_feature 1..18: note = motif sequence
  source 1..18: mol_type = other DNA
atctgaagagtcaatacc

SEQ ID NO: 854 - DNA, 18 bp, synthetic construct
  misc_feature 1..18: note = motif sequence
  source 1..18: mol_type = other DNA
ctgaagagtcaataccgc

SEQ ID NO: 855 - DNA, 18 bp, synthetic construct
  misc_feature 1..18: note = motif sequence
  source 1..18: mol_type = other DNA
gaagagtcaataccgcca

SEQ ID NO: 856 - DNA, 18 bp, synthetic construct
  misc_feature 1..18: note = motif sequence
  source 1..18: mol_type = other DNA
agagtcaataccgccaga

SEQ ID NO: 857 - DNA, 18 bp, synthetic construct
  misc_feature 1..18: note = motif sequence
  source 1..18: mol_type = other DNA
agtcaataccgccagaat

SEQ ID NO: 858 - DNA, 18 bp, synthetic construct
  misc_feature 1..18: note = motif sequence
  source 1..18: mol_type = other DNA
tcaataccgccagaatcc

SEQ ID NO: 859 - DNA, 18 bp, synthetic construct
  misc_feature 1..18: note = motif sequence
  source 1..18: mol_type = other DNA
taccgccagaatccatgg

SEQ ID NO: 860 - DNA, 18 bp, synthetic construct
  misc_feature 1..18: note = motif sequence
  source 1..18: mol_type = other DNA
ccgccagaatccatgggg

SEQ ID NO: 861 - DNA, 18 bp, synthetic construct
  misc_feature 1..18: note = motif sequence
  source 1..18: mol_type = other DNA
cagaatccatggggagat

SEQ ID NO: 862 - DNA, 18 bp, synthetic construct
  misc_feature 1..18: note = motif sequence
  source 1..18: mol_type = other DNA
gaatccatggggagatgt

SEQ ID NO: 863 - DNA, 18 bp, synthetic construct
  misc_feature 1..18: note = motif sequence
  source 1..18: mol_type = other DNA
atccatggggagatgttc

SEQ ID NO: 864 - DNA, 18 bp, synthetic construct
  misc_feature 1..18: note = motif sequence
  source 1..18: mol_type = other DNA
atggggagatgttctgga

SEQ ID NO: 865 - DNA, 18 bp, synthetic construct
  misc_feature 1..18: note = motif sequence
  source 1..18: mol_type = other DNA
ggggagatgttctggagg

SEQ ID NO: 866 - DNA, 18 bp, synthetic construct
  misc_feature 1..18: note = motif sequence
  source 1..18: mol_type = other DNA
ggagatgttctggagggg

SEQ ID NO: 867 - DNA, 18 bp, synthetic construct
  misc_feature 1..18: note = motif sequence
  source 1..18: mol_type = other DNA
agatgttctggaggggtg

SEQ ID NO: 868 - DNA, 18 bp, synthetic construct
  misc_feature 1..18: note = motif sequence
  source 1..18: mol_type = other DNA
atgttctggaggggtgac

SEQ ID NO: 869 - DNA, 18 bp, synthetic construct
  misc_feature 1..18: note = motif sequence
  source 1..18: mol_type = other DNA
gttctggaggggtgacaa

SEQ ID NO: 870 - DNA, 18 bp, synthetic construct
  misc_feature 1..18: note = motif sequence
  source 1..18: mol_type = other DNA
tctggaggggtgacaact

SEQ ID NO: 871 - DNA, 18 bp, synthetic construct
  misc_feature 1..18: note = motif sequence
  source 1..18: mol_type = other DNA
gaggggtgacaactgggc

SEQ ID NO: 872 - DNA, 18 bp, synthetic construct
  misc_feature 1..18: note = motif sequence
  source 1..18: mol_type = other DNA
ggggtgacaactgggcct

SEQ ID NO: 873 - DNA, 18 bp, synthetic construct
  misc_feature 1..18: note = motif sequence
  source 1..18: mol_type = other DNA
cagcagacccggccactg

SEQ ID NO: 874 - DNA, 18 bp, synthetic construct
  misc_feature 1..18: note = motif sequence
  source 1..18: mol_type = other DNA
gcagacccggccactggc

SEQ ID NO: 875 - DNA, 18 bp, synthetic construct
  misc_feature 1..18: note = motif sequence
  source 1..18: mol_type = other DNA
agacccggccactggcct

SEQ ID NO: 876 - DNA, 18 bp, synthetic construct
  misc_feature 1..18: note = motif sequence
  source 1..18: mol_type = other DNA
acccggccactggcctca

SEQ ID NO: 877 - DNA, 18 bp, synthetic construct
  misc_feature 1..18: note = motif sequence
  source 1..18: mol_type = other DNA
ccggccactggcctcact

SEQ ID NO: 878 - DNA, 18 bp, synthetic construct
  misc_feature 1..18: note = motif sequence
  source 1..18: mol_type = other DNA
ggccactggcctcacttc

SEQ ID NO: 879 - DNA, 18 bp, synthetic construct
  misc_feature 1..18: note = motif sequence
  source 1..18: mol_type = other DNA
ccactggcctcacttcat

SEQ ID NO: 880 - DNA, 18 bp, synthetic construct
  misc_feature 1..18: note = motif sequence
  source 1..18: mol_type = other DNA
actggcctcacttcattc

SEQ ID NO: 881 - DNA, 18 bp, synthetic construct
  misc_feature 1..18: note = motif sequence
  source 1..18: mol_type = other DNA
tggcctcacttcattccc

SEQ ID NO: 882 - DNA, 18 bp, synthetic construct
  misc_feature 1..18: note = motif sequence
  source 1..18: mol_type = other DNA
gcctcacttcattcccct

SEQ ID NO: 883 - DNA, 18 bp, synthetic construct
  misc_feature 1..18: note = motif sequence
  source 1..18: mol_type = other DNA
ctcacttcattcccctgg

SEQ ID NO: 884 - DNA, 18 bp, synthetic construct
  misc_feature 1..18: note = motif sequence
  source 1..18: mol_type = other DNA
cacttcattcccctggga

SEQ ID NO: 885 - DNA, 18 bp, synthetic construct
  misc_feature 1..18: note = motif sequence
  source 1..18: mol_type = other DNA
cttcattcccctgggagg

SEQ ID NO: 886 - DNA, 18 bp, synthetic construct
  misc_feature 1..18: note = motif sequence
  source 1..18: mol_type = other DNA
tcattcccctgggaggaa

SEQ ID NO: 887 - DNA, 18 bp, synthetic construct
  misc_feature 1..18: note = motif sequence
  source 1..18: mol_type = other DNA
attcccctgggaggaaag

SEQ ID NO: 888 - DNA, 18 bp, synthetic construct
  misc_feature 1..18: note = motif sequence
  source 1..18: mol_type = other DNA
tcccctgggaggaaagac

SEQ ID NO: 889 - DNA, 18 bp, synthetic construct
  misc_feature 1..18: note = motif sequence
  source 1..18: mol_type = other DNA
ccctgggaggaaagacca

SEQ ID NO: 890 - DNA, 18 bp, synthetic construct
  misc_feature 1..18: note = motif sequence
  source 1..18: mol_type = other DNA
ctgggaggaaagaccaaa

SEQ ID NO: 891 - DNA, 18 bp, synthetic construct
  misc_feature 1..18: note = motif sequence
  source 1..18: mol_type = other DNA
gggaggaaagaccaaagt

SEQ ID NO: 892 - DNA, 18 bp, synthetic construct
  misc_feature 1..18: note = motif sequence
  source 1..18: mol_type = other DNA
gaggaaagaccaaagtga

SEQ ID NO: 893 - DNA, 18 bp, synthetic construct
  misc_feature 1..18: note = motif sequence
  source 1..18: mol_type = other DNA
ggaaagaccaaagtgaat

SEQ ID NO: 894 - DNA, 18 bp, synthetic construct
  misc_feature 1..18: note = motif sequence
  source 1..18: mol_type = other DNA
aaagaccaaagtgaataa

SEQ ID NO: 895 - DNA, 18 bp, synthetic construct
  misc_feature 1..18: note = motif sequence
  source 1..18: mol_type = other DNA
agaccaaagtgaataaac

SEQ ID NO: 896 - DNA, 18 bp, synthetic construct
  misc_feature 1..18: note = motif sequence
  source 1..18: mol_type = other DNA
caaagtgaataaacagct

SEQ ID NO: 897 - DNA, 18 bp, synthetic construct
  misc_feature 1..18: note = motif sequence
  source 1..18: mol_type = other DNA
aagtgaataaacagcttc

SEQ ID NO: 898 - DNA, 18 bp, synthetic construct
  misc_feature 1..18: note = motif sequence
  source 1..18: mol_type = other DNA
gtgaataaacagcttcaa

SEQ ID NO: 899 - DNA, 18 bp, synthetic construct
  misc_feature 1..18: note = motif sequence
  source 1..18: mol_type = other DNA
gaataaacagcttcaagt

SEQ ID NO: 900 - DNA, 18 bp, synthetic construct
  misc_feature 1..18: note = motif sequence
  source 1..18: mol_type = other DNA
ataaacagcttcaagtgc

SEQ ID NO: 901 - DNA, 18 bp, synthetic construct
  misc_feature 1..18: note = target site sequence
  source 1..18: mol_type = other DNA
aggtgcaggcccagttgt

SEQ ID NO: 902 - DNA, 18 bp, synthetic construct
  misc_feature 1..18: note = target site sequence
  source 1..18: mol_type = other DNA
tgcagcaggtgcaggccc

SEQ ID NO: 903 - DNA, 18 bp, synthetic construct
  misc_feature 1..18: note = target site sequence
  source 1..18: mol_type = other DNA
cacctctgcagcaggtgc

SEQ ID NO: 904 - DNA, 18 bp, synthetic construct
  misc_feature 1..18: note = target site sequence
  source 1..18: mol_type = other DNA
tcagactacgtgcacctc

SEQ ID NO: 905 - DNA, 18 bp, synthetic construct
  misc_feature 1..18: note = target site sequence
  source 1..18: mol_type = other DNA
cagcactcagactacgtg

SEQ ID NO: 906 - DNA, 18 bp, synthetic construct
  misc_feature 1..18: note = target site sequence
  source 1..18: mol_type = other DNA
agtccgcagcactcagac

SEQ ID NO: 907 - DNA, 18 bp, synthetic construct
  misc_feature 1..18: note = target site sequence
  source 1..18: mol_type = other DNA
ctgctgagtccgcagcac

SEQ ID NO: 908 - DNA, 18 bp, synthetic construct
  misc_feature 1..18: note = target site sequence
  source 1..18: mol_type = other DNA
ccgggtctgctgagtccg

SEQ ID NO: 909 - DNA, 18 bp, synthetic construct
  misc_feature 1..18: note = target site sequence
  source 1..18: mol_type = other DNA
gcaggcccagttgtcacc

SEQ ID NO: 910 - DNA, 18 bp, synthetic construct
  misc_feature 1..18: note = target site sequence
  source 1..18: mol_type = other DNA
gcaggtgcaggcccagtt

SEQ ID NO: 911 - DNA, 18 bp, synthetic construct
  misc_feature 1..18: note = target site sequence
  source 1..18: mol_type = other DNA
cctctgcagcaggtgcag

SEQ ID NO: 912 - DNA, 18 bp, synthetic construct
  misc_feature 1..18: note = target site sequence
  source 1..18: mol_type = other DNA
cgtgcacctctgcagcag

SEQ ID NO: 913 - DNA, 18 bp, synthetic construct
  misc_feature 1..18: note = target site sequence
  source 1..18: mol_type = other DNA
actacgtgcacctctgca

SEQ ID NO: 914 - DNA, 18 bp, synthetic construct
  misc_feature 1..18: note = target site sequence
  source 1..18: mol_type = other DNA
agactacgtgcacctctg

SEQ ID NO: 915 - DNA, 18 bp, synthetic construct
  misc_feature 1..18: note = target site sequence
  source 1..18: mol_type = other DNA
actcagactacgtgcacc

SEQ ID NO: 916 - DNA, 18 bp, synthetic construct
  misc_feature 1..18: note = target site sequence
  source 1..18: mol_type = other DNA
gcactcagactacgtgca

SEQ ID NO: 917 - DNA, 18 bp, synthetic construct
  misc_feature 1..18: note = target site sequence
  source 1..18: mol_type = other DNA
cgcagcactcagactacg

SEQ ID NO: 918 - DNA, 18 bp, synthetic construct
  misc_feature 1..18: note = target site sequence
  source 1..18: mol_type = other DNA
tccgcagcactcagacta

SEQ ID NO: 919 - DNA, 18 bp, synthetic construct
  misc_feature 1..18: note = target site sequence
  source 1..18: mol_type = other DNA
tgagtccgcagcactcag

SEQ ID NO: 920 - DNA, 18 bp, synthetic construct
  misc_feature 1..18: note = target site sequence
  source 1..18: mol_type = other DNA
gctgagtccgcagcactc

SEQ ID NO: 921 - DNA, 18 bp, synthetic construct
  misc_feature 1..18: note = target site sequence
  source 1..18: mol_type = other DNA
gtctgctgagtccgcagc

SEQ ID NO: 922 - DNA, 18 bp, synthetic construct
  misc_feature 1..18: note = target site sequence
  source 1..18: mol_type = other DNA
gggtctgctgagtccgca

SEQ ID NO: 923 - DNA, 18 bp, synthetic construct
  misc_feature 1..18: note = target site sequence
  source 1..18: mol_type = other DNA
ggccgggtctgctgagtc

SEQ ID NO: 924 - DNA, 18 bp, synthetic construct
  misc_feature 1..18: note = target site sequence
  source 1..18: mol_type = other DNA
gtggccgggtctgctgag

SEQ ID NO: 925 - DNA, 18 bp, synthetic construct
  misc_feature 1..18: note = target site sequence
  source 1..18: mol_type = other DNA
aaagagctatataaccag

SEQ ID NO: 926 - DNA, 18 bp, synthetic construct
  misc_feature 1..18: note = target site sequence
  source 1..18: mol_type = other DNA
ttaaagagctatataacc

SEQ ID NO: 927 - DNA, 18 bp, synthetic construct
  misc_feature 1..18: note = target site sequence
  source 1..18: mol_type = other DNA
tattaaagagctatataa

SEQ ID NO: 928 - DNA, 18 bp, synthetic construct
  misc_feature 1..18: note = target site sequence
  source 1..18: mol_type = other DNA
cttattaaagagctatat

SEQ ID NO: 929 - DNA, 18 bp, synthetic construct
  misc_feature 1..18: note = target site sequence
  source 1..18: mol_type = other DNA
gacttattaaagagctat

SEQ ID NO: 930 - DNA, 18 bp, synthetic construct
  misc_feature 1..18: note = target site sequence
  source 1..18: mol_type = other DNA
ctgacttattaaagagct

SEQ ID NO: 931 - DNA, 18 bp, synthetic construct
  misc_feature 1..18: note = target site sequence
  source 1..18: mol_type = other DNA
ttctgacttattaaagag

SEQ ID NO: 932 - DNA, 18 bp, synthetic construct
  misc_feature 1..18: note = target site sequence
  source 1..18: mol_type = other DNA
cattctgacttattaaag

SEQ ID NO: 933 - DNA, 18 bp, synthetic construct
  misc_feature 1..18: note = target site sequence
  source 1..18: mol_type = other DNA
atcattctgacttattaa

SEQ ID NO: 934 - DNA, 18 bp, synthetic construct
  misc_feature 1..18: note = target site sequence
  source 1..18: mol_type = other DNA
ggatcattctgacttatt

SEQ ID NO: 935 - DNA, 18 bp, synthetic construct
  misc_feature 1..18: note = target site sequence
  source 1..18: mol_type = other DNA
agggatcattctgactta

SEQ ID NO: 936 - DNA, 18 bp, synthetic construct
  misc_feature 1..18: note = target site sequence
  source 1..18: mol_type = other DNA
gtagggatcattctgact

SEQ ID NO: 937 - DNA, 18 bp, synthetic construct
  misc_feature 1..18: note = target site sequence
  source 1..18: mol_type = other DNA
aggtagggatcattctga

SEQ ID NO: 938 - DNA, 18 bp, synthetic construct
  misc_feature 1..18: note = target site sequence
  source 1..18: mol_type = other DNA
agaggtagggatcattct

SEQ ID NO: 939 - DNA, 18 bp, synthetic construct
  misc_feature 1..18: note = target site sequence
  source 1..18: mol_type = other DNA
tcagaggtagggatcatt

SEQ ID NO: 940 - DNA, 18 bp, synthetic construct
  misc_feature 1..18: note = target site sequence
  source 1..18: mol_type = other DNA
agattcagaggtagggat

SEQ ID NO: 941 - DNA, 18 bp, synthetic construct
  misc_feature 1..18: note = target site sequence
  source 1..18: mol_type = other DNA
tcagattcagaggtaggg

SEQ ID NO: 942 - DNA, 18 bp, synthetic construct
  misc_feature 1..18: note = target site sequence
  source 1..18: mol_type = other DNA
cttcagattcagaggtag

SEQ ID NO: 943 - DNA, 18 bp, synthetic construct
  misc_feature 1..18: note = target site sequence
  source 1..18: mol_type = other DNA
ctcttcagattcagaggt

SEQ ID NO: 944 - DNA, 18 bp, synthetic construct
  misc_feature 1..18: note = target site sequence
  source 1..18: mol_type = other DNA
gactcttcagattcagag

SEQ ID NO: 945 - DNA, 18 bp, synthetic construct
  misc_feature 1..18: note = target site sequence
  source 1..18: mol_type = other DNA
ttgactcttcagattcag

SEQ ID NO: 946 - DNA, 18 bp, synthetic construct
  misc_feature 1..18: note = target site sequence
  source 1..18: mol_type = other DNA
ggtattgactcttcagat

SEQ ID NO: 947 - DNA, 18 bp, synthetic construct
  misc_feature 1..18: note = target site sequence
  source 1..18: mol_type = other DNA
gcggtattgactcttcag

SEQ ID NO: 948 - DNA, 18 bp, synthetic construct
  misc_feature 1..18: note = target site sequence
  source 1..18: mol_type = other DNA
tggcggtattgactcttc

SEQ ID NO: 949 - DNA, 18 bp, synthetic construct
  misc_feature 1..18: note = target site sequence
  source 1..18: mol_type = other DNA
tctggcggtattgactct

SEQ ID NO: 950 - DNA, 18 bp, synthetic construct
  misc_feature 1..18: note = target site sequence
  source 1..18: mol_type = other DNA
attctggcggtattgact

SEQ ID NO: 951 - DNA, 18 bp, synthetic construct
  misc_feature 1..18: note = target site sequence
  source 1..18: mol_type = other DNA
ggattctggcggtattga

SEQ ID NO: 952 - DNA, 18 bp, synthetic construct
  misc_feature 1..18: note = target site sequence
  source 1..18: mol_type = other DNA
ccatggattctggcggta

SEQ ID NO: 953 - DNA, 18 bp, synthetic construct
  misc_feature 1..18: note = target site sequence
  source 1..18: mol_type = other DNA
ccccatggattctggcgg

SEQ ID NO: 954 - DNA, 18 bp, synthetic construct
  misc_feature 1..18: note = target site sequence
  source 1..18: mol_type = other DNA
atctccccatggattctg

SEQ ID NO: 955 - DNA, 18 bp, synthetic construct
  misc_feature 1..18: note = target site sequence
  source 1..18: mol_type = other DNA
acatctccccatggattc

SEQ ID NO: 956 - DNA, 18 bp, synthetic construct
  misc_feature 1..18: note = target site sequence
  source 1..18: mol_type = other DNA
gaacatctccccatggat

SEQ ID NO: 957 - DNA, 18 bp, synthetic construct
  misc_feature 1..18: note = target site sequence
  source 1..18: mol_type = other DNA
tccagaacatctccccat

SEQ ID NO: 958 - DNA, 18 bp, synthetic construct
  misc_feature 1..18: note = target site sequence
  source 1..18: mol_type = other DNA
cctccagaacatctcccc

SEQ ID NO: 959 - DNA, 18 bp, synthetic construct
  misc_feature 1..18: note = target site sequence
  source 1..18: mol_type = other DNA
cccctccagaacatctcc

SEQ ID NO: 960 - DNA, 18 bp, synthetic construct
  misc_feature 1..18: note = target site sequence
  source 1..18: mol_type = other DNA
cacccctccagaacatct

SEQ ID NO: 961 - DNA, 18 bp, synthetic construct
  misc_feature 1..18: note = target site sequence
  source 1..18: mol_type = other DNA
gtcacccctccagaacat

SEQ ID NO: 962 - DNA, 18 bp, synthetic construct
  misc_feature 1..18: note = target site sequence
  source 1..18: mol_type = other DNA
ttgtcacccctccagaac

SEQ ID NO: 963 - DNA, 18 bp, synthetic construct
  misc_feature 1..18: note = target site sequence
  source 1..18: mol_type = other DNA
agttgtcacccctccaga

SEQ ID NO: 964 - DNA, 18 bp, synthetic construct
  misc_feature 1..18: note = target site sequence
  source 1..18: mol_type = other DNA
gcccagttgtcacccctc

SEQ ID NO: 965 - DNA, 18 bp, synthetic construct
  misc_feature 1..18: note = target site sequence
  source 1..18: mol_type = other DNA
aggcccagttgtcacccc

SEQ ID NO: 966 - DNA, 18 bp, synthetic construct
  misc_feature 1..18: note = target site sequence
  source 1..18: mol_type = other DNA
cagtggccgggtctgctg

SEQ ID NO: 967 - DNA, 18 bp, synthetic construct
  misc_feature 1..18: note = target site sequence
  source 1..18: mol_type = other DNA
gccagtggccgggtctgc

SEQ ID NO: 968 - DNA, 18 bp, synthetic construct
  misc_feature 1..18: note = target site sequence
  source 1..18: mol_type = other DNA
aggccagtggccgggtct

SEQ ID NO: 969 - DNA, 18 bp, synthetic construct
  misc_feature 1..18: note = target site sequence
  source 1..18: mol_type = other DNA
tgaggccagtggccgggt

SEQ ID NO: 970 - DNA, 18 bp, synthetic construct
  misc_feature 1..18: note = target site sequence
  source 1..18: mol_type = other DNA
agtgaggccagtggccgg

SEQ ID NO: 971 - DNA, 18 bp, synthetic construct
  misc_feature 1..18: note = target site sequence
  source 1..18: mol_type = other DNA
gaagtgaggccagtggcc

SEQ ID NO: 972 - DNA, 18 bp, synthetic construct
  misc_feature 1..18: note = target site sequence
  source 1..18: mol_type = other DNA
atgaagtgaggccagtgg

SEQ ID NO: 973 - DNA, 18 bp, synthetic construct
  misc_feature 1..18: note = target site sequence
  source 1..18: mol_type = other DNA
gaatgaagtgaggccagt

SEQ ID NO: 974 - DNA, 18 bp, synthetic construct
  misc_feature 1..18: note = target site sequence
  source 1..18: mol_type = other DNA
gggaatgaagtgaggcca

SEQ ID NO: 975 - DNA, 18 bp, synthetic construct
  misc_feature 1..18: note = target site sequence
  source 1..18: mol_type = other DNA
aggggaatgaagtgaggc

SEQ ID NO: 976 - DNA, 18 bp, synthetic construct
  misc_feature 1..18: note = target site sequence
  source 1..18: mol_type = other DNA
ccaggggaatgaagtgag

SEQ ID NO: 977 - DNA, 18 bp, synthetic construct
  misc_feature 1..18: note = target site sequence
  source 1..18: mol_type = other DNA
tcccaggggaatgaagtg

SEQ ID NO: 978 - DNA, 18 bp, synthetic construct
  misc_feature 1..18: note = target site sequence
  source 1..18: mol_type = other DNA
cctcccaggggaatgaag

SEQ ID NO: 979 - DNA, 18 bp, synthetic construct
  misc_feature 1..18: note = target site sequence
  source 1..18: mol_type = other DNA
ttcctcccaggggaatga

SEQ ID NO: 980 - DNA, 18 bp, synthetic construct
  misc_feature 1..18: note = target site sequence
  source 1..18: mol_type = other DNA
ctttcctcccaggggaat

SEQ ID NO: 981 - DNA, 18 bp, synthetic construct
  misc_feature 1..18: note = target site sequence
  source 1..18: mol_type = other DNA
gtctttcctcccagggga

SEQ ID NO: 982 - DNA, 18 bp, synthetic construct
  misc_feature 1..18: note = target site sequence
  source 1..18: mol_type = other DNA
tggtctttcctcccaggg

SEQ ID NO: 983 - DNA, 18 bp, synthetic construct
  misc_feature 1..18: note = target site sequence
  source 1..18: mol_type = other DNA
tttggtctttcctcccag

SEQ ID NO: 984 - DNA, 18 bp, synthetic construct
  misc_feature 1..18: note = target site sequence
  source 1..18: mol_type = other DNA
actttggtctttcctccc

SEQ ID NO: 985 - DNA, 18 bp, synthetic construct
  misc_feature 1..18: note = target site sequence
  source 1..18: mol_type = other DNA
tcactttggtctttcctc

SEQ ID NO: 986 - DNA, 18 bp, synthetic construct
  misc_feature 1..18: note = target site sequence
  source 1..18: mol_type = other DNA
attcactttggtctttcc

SEQ ID NO: 987 - DNA, 18 bp, synthetic construct
  misc_feature 1..18: note = target site sequence
  source 1..18: mol_type = other DNA
ttattcactttggtcttt

SEQ ID NO: 988 - DNA, 18 bp, synthetic construct
  misc_feature 1..18: note = target site sequence
  source 1..18: mol_type = other DNA
gtttattcactttggtct

SEQ ID NO: 989 - DNA, 18 bp, synthetic construct
  misc_feature 1..18: note = target site sequence
  source 1..18: mol_type = other DNA
agctgtttattcactttg

SEQ ID NO: 990 - DNA, 18 bp, synthetic construct
  misc_feature 1..18: note = target site sequence
  source 1..18: mol_type = other DNA
gaagctgtttattcactt

SEQ ID NO: 991 - DNA, 18 bp, synthetic construct
  misc_feature 1..18: note = target site sequence
  source 1..18: mol_type = other DNA
ttgaagctgtttattcac

SEQ ID NO: 992 - DNA, 18 bp, synthetic construct
  misc_feature 1..18: note = target site sequence
  source 1..18: mol_type = other DNA
acttgaagctgtttattc

SEQ ID NO: 993 - DNA, 18 bp, synthetic construct
  misc_feature 1..18: note = target site sequence
  source 1..18: mol_type = other DNA
gcacttgaagctgtttat

SEQ ID NO: 994 - DNA, 18 bp, synthetic construct
  misc_feature 1..18: note = Primer 2 (XBP1 WT and XBP1delta4 assays)
  source 1..18: mol_type = other DNA
gttcctccagattggcag

SEQ ID NO: 995 - DNA, 19 bp, synthetic construct
  misc_feature 1..19: note = Primer 1 (XBP1 WT and XBP1delta4 assays)
  source 1..19: mol_type = other DNA
ccaggagttaagaactcgc

SEQ ID NO: 996 - DNA, 23 bp, synthetic construct
  misc_feature 1..23: note = Probe (XBP1 WT assay)
  misc_feature 9..10: note = internal ZEN quencher between nucleotides 9 and 10
  source 1..23: mol_type = other DNA
cggagtccaagggaaatggagta

SEQ ID NO: 997 - DNA, 26 bp, synthetic construct
  misc_feature 1..26: note = Probe (XBP1delta4 assay)
  misc_feature 9..10: note = internal ZEN quencher between nucleotides 9 and 10
  source 1..26: mol_type = other DNA
cggagtccaagtctgatatccttttg

SEQ ID NO: 998 - DNA, 16 bp, synthetic construct
  misc_feature 1..16: note = Primer 2 (XBP1 WT and XBP1delta4 assays)
  source 1..16: mol_type = other DNA
agggtccaacttgtcc

SEQ ID NO: 999 - DNA, 19 bp, synthetic construct
  misc_feature 1..19: note = Primer 1 (XBP1 WT and XBP1delta4 assays)
  source 1..19: mol_type = other DNA
ctggatcctgacgaggttc

SEQ ID NO: 1000 - DNA, 25 bp, synthetic construct
  misc_feature 1..25: note = Probe (XBP1 WT assay)
  misc_feature 9..10: note = internal ZEN quencher between nucleotides 9 and 10
  source 1..25: mol_type = other DNA
cttactccactccccttggcctcca

SEQ ID NO: 1001 - DNA, 28 bp, synthetic construct
  misc_feature 1..28: note = Probe (XBP1delta4 assay)
  misc_feature 9..10: note = internal ZEN quencher between nucleotides 9 and 10
  source 1..28: mol_type = other DNA
cccaaaaggatatcagacttggcctcca

SEQ ID NO: 1002 - DNA, 20 bp, synthetic construct
  misc_feature 1..20: note = Primer 2 (XBP1 WT and XBP1delta4 assays)
  source 1..20: mol_type = other DNA
ctgggtccaagttgtccaga

SEQ ID NO: 1003 - DNA, 18 bp, synthetic construct
  misc_feature 1..18: note = Primer 1 (XBP1 WT and XBP1delta4 assays)
  source 1..18: mol_type = other DNA
atgccctggttgctgaag

SEQ ID NO: 1004 - DNA, 25 bp, synthetic construct
  misc_feature 1..25: note = Probe (XBP1 WT assay)
  misc_feature 9..10: note = internal ZEN quencher between nucleotides 9 and 10
  source 1..25: mol_type = other DNA
tcacttcattccccttggcttccgc

SEQ ID NO: 1005 - DNA, 28 bp, synthetic construct
  misc_feature 1..28: note = Probe (XBP1delta4 assay)
  misc_feature 9..10: note = internal ZEN quencher between nucleotides 9 and 10
  source 1..28: mol_type = other DNA
ccaacaggatatcagacttggcttccgc

SEQ ID NO: 1006 - RNA, 62 nt, synthetic construct
  misc_feature 1..62: note = sequence involved in the alternative IRE1 mediated splicing event
  source 1..62: mol_type = other RNA
ccgggtctgctgagtccgcagcactcagactacgtgcacctctgcagcaggtgcaggcccag

SEQ ID NO: 1007 - RNA, 36 nt, synthetic construct
  misc_feature 1..36: note = sequence involved in the alternative IRE1 mediated splicing event
  source 1..36: mol_type = other RNA
ccgggtctgctgagtccgcagcaggtgcaggcccag

SEQ ID NO: 1008 - protein, 216 aa, Cricetulus griseus
ARKRQRLTHLSPEEKALRRKLKNRVAAQTARDRKKARMSELEQQVVDLEEENQKLLLENQLLREKTHGLVIENQELRTRLGMDVLTTEEAPETESKGNGVRPVAGSAESAALRLRAPLQQVQAQLSPPQNIFPWILTLLTLQTPSLISFWAFWTSWTLSCFSNVHPQSLPIWRNSQRSTQDLVPYQPPFLCQWGPHQPSWKPLMNSFALTMYTPSL

SEQ ID NO: 1009 - protein, 320 aa, Cricetulus griseus
ARKRQRLTHLSPEEKALRRKLKNRVAAQTARDRKKARMSELEQQVVDLEEENQKLLLENQLLREKTHGLVIENQELRTRLGMDVLTTEEAPETESKGNGVRPVAGSAESAAGAGPVVTSPEHLPMDSDTVDSSDSESDILLGILDKLDPVMFFKCPSPESANLEELPEVYPGPSSLPASLSLSVGTSSAKLEAINELIRFDHVYTKPLVLEIPSETESQTNVVVKIEEAPLSSSEEDHPEFIVSVKKEPLEEDFIPEPGISNLLSSSHCLKPSSCLLDAYSDCGYEGSPSPFSDMSSPLGIDHSWEDTFANELFPQLISV

SEQ ID NO: 1010 - protein, 280 aa, synthetic construct
  REGION 1..280: note = protein sequence encoded by the XBP1delta4 variant
ARKRQRLTHLSPEEKALRRKLKNRVAAQTARDRKKARMSELEQQVVDLEEENQKLLLENQLLREKTHGLVIENQELRTRLGMDVLTTEEAPETESKSDILLGILDKLDPVMFFKCPSPESANLEELPEVYPGPSSLPASLSLSVGTSSAKLEAINELIRFDHVYTKPLVLEIPSETESQTNVVVKIEEAPLSSSEEDHPEFIVSVKKEPLEEDFIPEPGISNLLSSSHCLKPSSCLLDAYSDCGYEGSPSPFSDMSSPLGIDHSWEDTFANELFPQLISV

SEQ ID NO: 1011 - DNA, 14 bp, synthetic construct
  misc_feature 1..14: note = Description of sequence: modified hamster DNA tageting: SEQ ID 299(CTTTCCTTCCAGGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
ccctggaaggaaag

SEQ ID NO: 1012 - DNA, 14 bp, synthetic construct
  misc_feature 1..14: note = Description of sequence: modified hamster DNA tageting: SEQ ID 300(TTCCTTCCAGGGAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ttccctggaaggaa

SEQ ID NO: 1013 - DNA, 14 bp, synthetic construct
  misc_feature 1..14: note = Description of sequence: modified hamster DNA tageting: SEQ ID 301(TCCTTCCAGGGAAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
tttccctggaagga

SEQ ID NO: 1014 - DNA, 14 bp, synthetic construct
  misc_feature 1..14: note = Description of sequence: modified hamster DNA tageting: SEQ ID 302(CCTTCCAGGGAAAT)
  source 1..14: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
atttccctggaagg

SEQ ID NO: 1015 - DNA, 14 bp, synthetic construct
  misc_feature 1..14: note = Description of sequence: modified hamster DNA tageting: SEQ ID 303(CTTCCAGGGAAATG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
catttccctggaag

SEQ ID NO: 1016 - DNA, 14 bp, synthetic construct
  misc_feature 1..14: note = Description of sequence: modified hamster DNA tageting: SEQ ID 304(TTCCAGGGAAATGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ccatttccctggaa

SEQ ID NO: 1017 - DNA, 14 bp, synthetic construct
  misc_feature 1..14: note = Description of sequence: modified hamster DNA tageting: SEQ ID 305(TCCAGGGAAATGGA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
tccatttccctgga

SEQ ID NO: 1018 - DNA, 14 bp, synthetic construct
  misc_feature 1..14: note = Description of sequence: modified hamster DNA tageting: SEQ ID 306(CCAGGGAAATGGAG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
ctccatttccctgg

SEQ ID NO: 1019 - DNA, 14 bp, synthetic construct
  misc_feature 1..14: note = Description of sequence: modified hamster DNA tageting: SEQ ID 307(CAGGGAAATGGAGT)
  source 1..14: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
actccatttccctg

SEQ ID NO: 1020 - DNA, 14 bp, synthetic construct
  misc_feature 1..14: note = Description of sequence: modified hamster DNA tageting: SEQ ID 308(AGGGAAATGGAGTA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
tactccatttccct

SEQ ID NO: 1021 - DNA, 14 bp, synthetic construct
  misc_feature 1..14: note = Description of sequence: modified hamster DNA tageting: SEQ ID 309(GGGAAATGGAGTAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
ttactccatttccc

SEQ ID NO: 1022 - DNA, 14 bp, synthetic construct
  misc_feature 1..14: note = Description of sequence: modified hamster DNA tageting: SEQ ID 310(GGAAATGGAGTAAG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
cttactccatttcc

SEQ ID NO: 1023 - DNA, 14 bp, synthetic construct
  misc_feature 1..14: note = Description of sequence: modified hamster DNA tageting: SEQ ID 311(GAAATGGAGTAAGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
ccttactccatttc

SEQ ID NO: 1024 - DNA, 14 bp, synthetic construct
  misc_feature 1..14: note = Description of sequence: modified hamster DNA tageting: SEQ ID 312(AAATGGAGTAAGGC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
gccttactccattt

SEQ ID NO: 1025 - DNA, 14 bp, synthetic construct
  misc_feature 1..14: note = Description of sequence: modified hamster DNA tageting: SEQ ID 313(AATGGAGTAAGGCC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
ggccttactccatt

SEQ ID NO: 1026 - DNA, 14 bp, synthetic construct
  misc_feature 1..14: note = Description of sequence: modified hamster DNA tageting: SEQ ID 314(CACTTTGGTCTTTC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
gaaagaccaaagtg

SEQ ID NO: 1027 - DNA, 14 bp, synthetic construct
  misc_feature 1..14: note = Description of sequence: modified hamster DNA tageting: SEQ ID 315(CTTTGGTCTTTCCT)
  source 1..14: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
aggaaagaccaaag

SEQ ID NO: 1028 - DNA, 14 bp, synthetic construct
  misc_feature 1..14: note = Description of sequence: modified hamster DNA tageting: SEQ ID 316(TTGGTCTTTCCTTC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
gaaggaaagaccaa

SEQ ID NO: 1029 - DNA, 14 bp, synthetic construct
  misc_feature 1..14: note = Description of sequence: modified hamster DNA tageting: SEQ ID 317(TGGTCTTTCCTTCC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ggaaggaaagacca

SEQ ID NO: 1030 - DNA, 14 bp, synthetic construct
  misc_feature 1..14: note = Description of sequence: modified hamster DNA tageting: SEQ ID 318(GGTCTTTCCTTCCA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
tggaaggaaagacc

SEQ ID NO: 1031 - DNA, 14 bp, synthetic construct
  misc_feature 1..14: note = Description of sequence: modified hamster DNA tageting: SEQ ID 319(GTCTTTCCTTCCAG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
ctggaaggaaagac

SEQ ID NO: 1032 - DNA, 14 bp, synthetic construct
  misc_feature 1..14: note = Description of sequence: modified hamster DNA tageting: SEQ ID 320(TCTTTCCTTCCAGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
cctggaaggaaaga

SEQ ID NO: 1033 - DNA, 14 bp, synthetic construct
  misc_feature 1..14: note = Description of sequence: modified hamster DNA tageting: SEQ ID 321(CTTTCCTTCCAGGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
ccctggaaggaaag

SEQ ID NO: 1034 - DNA, 14 bp, synthetic construct
  misc_feature 1..14: note = Description of sequence: modified hamster DNA tageting: SEQ ID 322(TTTCCTTCCAGGGA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
tccctggaaggaaa

SEQ ID NO: 1035 - DNA, 14 bp, synthetic construct
  misc_feature 1..14: note = Description of sequence: modified hamster DNA tageting: SEQ ID 323(TTCCTTCCAGGGAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ttccctggaaggaa

SEQ ID NO: 1036 - DNA, 14 bp, synthetic construct
  misc_feature 1..14: note = Description of sequence: modified hamster DNA tageting: SEQ ID 324(TCCTTCCAGGGAAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
tttccctggaagga

SEQ ID NO: 1037 - DNA, 14 bp, synthetic construct
  misc_feature 1..14: note = Description of sequence: modified hamster DNA tageting: SEQ ID 325(CCTTCCAGGGAAAT)
  source 1..14: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
atttccctggaagg

SEQ ID NO: 1038 - DNA, 14 bp, synthetic construct
  misc_feature 1..14: note = Description of sequence: modified hamster DNA tageting: SEQ ID 326(CTTCCAGGGAAATG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
catttccctggaag

SEQ ID NO: 1039 - DNA, 14 bp, synthetic construct
  misc_feature 1..14: note = Description of sequence: modified hamster DNA tageting: SEQ ID 327(TTCCAGGGAAATGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ccatttccctggaa

SEQ ID NO: 1040 - DNA, 14 bp, synthetic construct
  misc_feature 1..14: note = Description of sequence: modified hamster DNA tageting: SEQ ID 328(TCCAGGGAAATGGA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
tccatttccctgga

SEQ ID NO: 1041 - DNA, 14 bp, synthetic construct
  misc_feature 1..14: note = Description of sequence: modified hamster DNA tageting: SEQ ID 329(CCAGGGAAATGGAG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
ctccatttccctgg

SEQ ID NO: 1042 - DNA, 14 bp, synthetic construct
  misc_feature 1..14: note = Description of sequence: modified hamster DNA tageting: SEQ ID 330(CAGGGAAATGGAGT)
  source 1..14: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
actccatttccctg

SEQ ID NO: 1043 - DNA, 14 bp, synthetic construct
  misc_feature 1..14: note = Description of sequence: modified hamster DNA tageting: SEQ ID 331(AGGGAAATGGAGTA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
tactccatttccct

SEQ ID NO: 1044 - DNA, 14 bp, synthetic construct
  misc_feature 1..14: note = Description of sequence: modified hamster DNA tageting: SEQ ID 332(GGGAAATGGAGTAA)
  source 1..14: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
ttactccatttccc

SEQ ID NO: 1045 - DNA, 14 bp, synthetic construct
  misc_feature 1..14: note = Description of sequence: modified hamster DNA tageting: SEQ ID 333(GGAAATGGAGTAAG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
cttactccatttcc

SEQ ID NO: 1046 - DNA, 14 bp, synthetic construct
  misc_feature 1..14: note = Description of sequence: modified hamster DNA tageting: SEQ ID 334(GAAATGGAGTAAGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
ccttactccatttc

SEQ ID NO: 1047 - DNA, 14 bp, synthetic construct
  misc_feature 1..14: note = Description of sequence: modified hamster DNA tageting: SEQ ID 335(AAATGGAGTAAGGC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
gccttactccattt

SEQ ID NO: 1048 - DNA, 14 bp, synthetic construct
  misc_feature 1..14: note = Description of sequence: modified hamster DNA tageting: SEQ ID 336(AATGGAGTAAGGCC)
  source 1..14: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
ggccttactccatt

SEQ ID NO: 1049 - DNA, 14 bp, synthetic construct
  misc_feature 1..14: note = Description of sequence: modified hamster DNA tageting: SEQ ID 337(TGGAGTAAGGCCGG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
ccggccttactcca

SEQ ID NO: 1050 - DNA, 14 bp, synthetic construct
  misc_feature 1..14: note = Description of sequence: modified hamster DNA tageting: SEQ ID 338(GAGTAAGGCCGGTG)
  source 1..14: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
caccggccttactc

SEQ ID NO: 1051 - DNA, 18 bp, synthetic construct
  misc_feature 1..18: note = Description of sequence: modified hamster DNA tageting: SEQ ID 339(TTTCTTAATTTCCAGTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ccactggaaattaagaaa

SEQ ID NO: 1052 - DNA, 18 bp, synthetic construct
  misc_feature 1..18: note = Description of sequence: modified hamster DNA tageting: SEQ ID 340(CACTTTCTTAATTTCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctggaaattaagaaagtg

SEQ ID NO: 1053 - DNA, 18 bp, synthetic construct
  misc_feature 1..18: note = Description of sequence: modified hamster DNA tageting: SEQ ID 341(AGTCACTTTCTTAATTTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gaaattaagaaagtgact

SEQ ID NO: 1054 - DNA, 18 bp, synthetic construct
  misc_feature 1..18: note = Description of sequence: modified hamster DNA tageting: SEQ ID 342(AGCAGTCACTTTCTTAAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
attaagaaagtgactgct

SEQ ID NO: 1055 - DNA, 18 bp, synthetic construct
  misc_feature 1..18: note = Description of sequence: modified hamster DNA tageting: SEQ ID 343(GTAAGCAGTCACTTTCTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aagaaagtgactgcttac

SEQ ID NO: 1056 - DNA, 18 bp, synthetic construct
  misc_feature 1..18: note = Description of sequence: modified hamster DNA tageting: SEQ ID 344(GGGGTAAGCAGTCACTTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aaagtgactgcttacccc

SEQ ID NO: 1057 - DNA, 18 bp, synthetic construct
  misc_feature 1..18: note = Description of sequence: modified hamster DNA tageting: SEQ ID 345(TTAGGGGTAAGCAGTCAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtgactgcttacccctaa

SEQ ID NO: 1058 - DNA, 18 bp, synthetic construct
  misc_feature 1..18: note = Description of sequence: modified hamster DNA tageting: SEQ ID 346(GGGTTAGGGGTAAGCAGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
actgcttacccctaaccc

SEQ ID NO: 1059 - DNA, 18 bp, synthetic construct
  misc_feature 1..18: note = Description of sequence: modified hamster DNA tageting: SEQ ID 347(GTAGGGTTAGGGGTAAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcttacccctaaccctac

SEQ ID NO: 1060 - DNA, 18 bp, synthetic construct
  misc_feature 1..18: note = Description of sequence: modified hamster DNA tageting: SEQ ID 348(TTGGTAGGGTTAGGGGTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tacccctaaccctaccaa

SEQ ID NO: 1061 - DNA, 18 bp, synthetic construct
  misc_feature 1..18: note = Description of sequence: modified hamster DNA tageting: SEQ ID 349(GTATTGGTAGGGTTAGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ccctaaccctaccaatac

SEQ ID NO: 1062 - DNA, 18 bp, synthetic construct
  misc_feature 1..18: note = Description of sequence: modified hamster DNA tageting: SEQ ID 350(TTAGTATTGGTAGGGTTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
taaccctaccaatactaa

SEQ ID NO: 1063 - DNA, 18 bp, synthetic construct
  misc_feature 1..18: note = Description of sequence: modified hamster DNA tageting: SEQ ID 351(AAGTTAGTATTGGTAGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccctaccaatactaactt

SEQ ID NO: 1064 - DNA, 18 bp, synthetic construct
  misc_feature 1..18: note = Description of sequence: modified hamster DNA tageting: SEQ ID 352(AAGAAGTTAGTATTGGTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
taccaatactaacttctt

SEQ ID NO: 1065 - DNA, 18 bp, synthetic construct
  misc_feature 1..18: note = Description of sequence: modified hamster DNA tageting: SEQ ID 353(AGAAAGAAGTTAGTATTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA thymine nucleosid
  misc_feature 16: note = Backbone sugar is not deoxyribose e
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caatactaacttctttct

SEQ ID NO: 1066 - DNA, 18 bp, synthetic construct
  misc_feature 1..18: note = Description of sequence: modified hamster DNA tageting: SEQ ID 354(TGGAGAAAGAAGTTAGTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tactaacttctttctcca

SEQ ID NO: 1067 - DNA, 18 bp, synthetic construct
  misc_feature 1..18: note = Description of sequence: modified hamster DNA tageting: SEQ ID 355(AAATGGAGAAAGAAGTTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
taacttctttctccattt

SEQ ID NO: 1068 - DNA, 18 bp, synthetic construct
  misc_feature 1..18: note = Description of sequence: modified hamster DNA tageting: SEQ ID 356(GGCAAATGGAGAAAGAAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cttctttctccatttgcc

SEQ ID NO: 1069 - DNA, 18 bp, synthetic construct
  misc_feature 1..18: note = Description of sequence: modified hamster DNA tageting: SEQ ID 357(CCAGGCAAATGGAGAAAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctttctccatttgcctgg

SEQ ID NO: 1070 - DNA, 18 bp, synthetic construct
  misc_feature 1..18: note = Description of sequence: modified hamster DNA tageting: SEQ ID 358(TAGCCAGGCAAATGGAGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tctccatttgcctggcta

SEQ ID NO: 1071 - DNA, 18 bp, synthetic construct
  misc_feature 1..18: note = Description of sequence: modified hamster DNA tageting: SEQ ID 359(GCCTAGCCAGGCAAATGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ccatttgcctggctaggc

SEQ ID NO: 1072 - DNA, 18 bp, synthetic construct
  misc_feature 1..18: note = Description of sequence: modified hamster DNA tageting: SEQ ID 360(CATGCCTAGCCAGGCAAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tttgcctggctaggcatg

SEQ ID NO: 1073 - DNA, 18 bp, synthetic construct
  misc_feature 1..18: note = Description of sequence: modified hamster DNA tageting: SEQ ID 361(TGACATGCCTAGCCAGGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gcctggctaggcatgtca

SEQ ID NO: 1074 - DNA, 18 bp, synthetic construct
  misc_feature 1..18: note = Description of sequence: modified hamster DNA tageting: SEQ ID 362(GTGTGACATGCCTAGCCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tggctaggcatgtcacac

SEQ ID NO: 1075 - DNA, 18 bp, synthetic construct
  misc_feature 1..18: note = Description of sequence: modified hamster DNA tageting: SEQ ID 363(GATGTGTGACATGCCTAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctaggcatgtcacacatc

SEQ ID NO: 1076 - DNA, 18 bp, synthetic construct
  misc_feature 1..18: note = Description of sequence: modified hamster DNA tageting: SEQ ID 364(TATGATGTGTGACATGCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ggcatgtcacacatcata

SEQ ID NO: 1077 - DNA, 18 bp, synthetic construct
  misc_feature 1..18: note = Description of sequence: modified hamster DNA tageting: SEQ ID 365(ATATATGATGTGTGACAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
atgtcacacatcatatat

SEQ ID NO: 1078 - DNA, 18 bp, synthetic construct
  misc_feature 1..18: note = Description of sequence: modified hamster DNA tageting: SEQ ID 366(TATATATATGATGTGTGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcacacatcatatatata

SEQ ID NO: 1079 - DNA, 18 bp, synthetic construct
  misc_feature 1..18: note = Description of sequence: modified hamster DNA tageting: SEQ ID 367(TAGTATATATATGATGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cacatcatatatatacta

SEQ ID NO: 1080 - DNA, 18 bp, synthetic construct
  misc_feature 1..18: note = Description of sequence: modified hamster DNA tageting: SEQ ID 368(CTGTAGTATATATATGAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA 5-methyl cytosine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atcatatatatactacag

SEQ ID NO: 1081 - DNA, 18 bp, synthetic construct
  misc_feature 1..18: note = Description of sequence: modified hamster DNA tageting: SEQ ID 369(ATTCTGTAGTATATATAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
atatatatactacagaat

SEQ ID NO: 1082 - DNA, 18 bp, synthetic construct
  misc_feature 1..18: note = Description of sequence: modified hamster DNA tageting: SEQ ID 370(CTCATTCTGTAGTATATA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tatatactacagaatgag

SEQ ID NO: 1083 - DNA, 18 bp, synthetic construct
  misc_feature 1..18: note = Description of sequence: modified hamster DNA tageting: SEQ ID 371(TGGCTCATTCTGTAGTAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
atactacagaatgagcca

SEQ ID NO: 1084 - DNA, 18 bp, synthetic construct
  misc_feature 1..18: note = Description of sequence: modified hamster DNA tageting: SEQ ID 372(GATTGGCTCATTCTGTAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctacagaatgagccaatc

SEQ ID NO: 1085 - DNA, 18 bp, synthetic construct
  misc_feature 1..18: note = Description of sequence: modified hamster DNA tageting: SEQ ID 373(TAAGATTGGCTCATTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cagaatgagccaatctta

SEQ ID NO: 1086 - DNA, 18 bp, synthetic construct
  misc_feature 1..18: note = Description of sequence: modified hamster DNA tageting: SEQ ID 374(GTGTAAGATTGGCTCATT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aatgagccaatcttacac

SEQ ID NO: 1087 - DNA, 18 bp, synthetic construct
  misc_feature 1..18: note = Description of sequence: modified hamster DNA tageting: SEQ ID 375(ACTGTGTAAGATTGGCTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gagccaatcttacacagt

SEQ ID NO: 1088 - DNA, 18 bp, synthetic construct
  misc_feature 1..18: note = Description of sequence: modified hamster DNA tageting: SEQ ID 376(AGCACTGTGTAAGATTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccaatcttacacagtgct

SEQ ID NO: 1089 - DNA, 18 bp, synthetic construct
  misc_feature 1..18: note = Description of sequence: modified hamster DNA tageting: SEQ ID 377(TAAAGCACTGTGTAAGAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
atcttacacagtgcttta

SEQ ID NO: 1090 - DNA, 18 bp, synthetic construct
  misc_feature 1..18: note = Description of sequence: modified hamster DNA tageting: SEQ ID 378(TACTAAAGCACTGTGTAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ttacacagtgctttagta

SEQ ID NO: 1091 - DNA, 18 bp, synthetic construct
  misc_feature 1..18: note = Description of sequence: modified hamster DNA tageting: SEQ ID 379(CCTTACTAAAGCACTGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cacagtgctttagtaagg

SEQ ID NO: 1092 - DNA, 18 bp, synthetic construct
  misc_feature 1..18: note = Description of sequence: modified hamster DNA tageting: SEQ ID 380(TTGCCTTACTAAAGCACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtgctttagtaaggcaa

SEQ ID NO: 1093 - DNA, 18 bp, synthetic construct
  misc_feature 1..18: note = Description of sequence: modified hamster DNA tageting: SEQ ID 381(TGTTTGCCTTACTAAAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gctttagtaaggcaaaca

SEQ ID NO: 1094 - DNA, 18 bp, synthetic construct
  misc_feature 1..18: note = Description of sequence: modified hamster DNA tageting: SEQ ID 382(GCTTGTTTGCCTTACTAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttagtaaggcaaacaagc

SEQ ID NO: 1095 - DNA, 18 bp, synthetic construct
  misc_feature 1..18: note = Description of sequence: modified hamster DNA tageting: SEQ ID 383(AGAGCTTGTTTGCCTTAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gtaaggcaaacaagctct

SEQ ID NO: 1096 - DNA, 18 bp, synthetic construct
  misc_feature 1..18: note = Description of sequence: modified hamster DNA tageting: SEQ ID 384(GGTAGAGCTTGTTTGCCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aggcaaacaagctctacc

SEQ ID NO: 1097 - DNA, 18 bp, synthetic construct
  misc_feature 1..18: note = Description of sequence: modified hamster DNA tageting: SEQ ID 385(CGAGGTAGAGCTTGTTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
caaacaagctctacctcg

SEQ ID NO: 1098 - DNA, 18 bp, synthetic construct
  misc_feature 1..18: note = Description of sequence: modified hamster DNA tageting: SEQ ID 386(CTCCGAGGTAGAGCTTGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
acaagctctacctcggag

SEQ ID NO: 1099 - DNA, 18 bp, synthetic construct
  misc_feature 1..18: note = Description of sequence: modified hamster DNA tageting: SEQ ID 387(AGACTCCGAGGTAGAGCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agctctacctcggagtct

SEQ ID NO: 1100 - DNA, 18 bp, synthetic construct
  misc_feature 1..18: note = Description of sequence: modified hamster DNA tageting: SEQ ID 388(TTCAGACTCCGAGGTAGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  modified_base 8: mod_base = m5c
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tctacctcggagtctgaa

SEQ ID NO: 1101 - DNA, 18 bp, synthetic construct
  misc_feature 1..18: note = Description of sequence: modified hamster DNA tageting: SEQ ID 389(CTCTTCAGACTCCGAGGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
acctcggagtctgaagag

SEQ ID NO: 1102 - DNA, 18 bp, synthetic construct
  misc_feature 1..18: note = Description of sequence: modified hamster DNA tageting: SEQ ID 390(TGACTCTTCAGACTCCGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 2: mod_base = m5c
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcggagtctgaagagtca

SEQ ID NO: 1103 - DNA, 18 bp, synthetic construct
  misc_feature 1..18: note = Description of sequence: modified hamster DNA tageting: SEQ ID 391(TGTTGACTCTTCAGACTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gagtctgaagagtcaaca

SEQ ID NO: 1104 - DNA, 18 bp, synthetic construct
  misc_feature 1..18: note = Description of sequence: modified hamster DNA tageting: SEQ ID 392(CACTGTTGACTCTTCAGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tctgaagagtcaacagtg

SEQ ID NO: 1105 - DNA, 18 bp, synthetic construct
  misc_feature 1..18: note = Description of sequence: modified hamster DNA tageting: SEQ ID 393(TGACACTGTTGACTCTTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaagagtcaacagtgtca

SEQ ID NO: 1106 - DNA, 18 bp, synthetic construct
  misc_feature 1..18: note = Description of sequence: modified hamster DNA tageting: SEQ ID 394(TTCTGACACTGTTGACTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gagtcaacagtgtcagaa

SEQ ID NO: 1107 - DNA, 18 bp, synthetic construct
  misc_feature 1..18: note = Description of sequence: modified hamster DNA tageting: SEQ ID 395(GGATTCTGACACTGTTGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tcaacagtgtcagaatcc

SEQ ID NO: 1108 - DNA, 18 bp, synthetic construct
  misc_feature 1..18: note = Description of sequence: modified hamster DNA tageting: SEQ ID 396(CATGGATTCTGACACTGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
acagtgtcagaatccatg

SEQ ID NO: 1109 - DNA, 18 bp, synthetic construct
  misc_feature 1..18: note = Description of sequence: modified hamster DNA tageting: SEQ ID 397(TCCCATGGATTCTGACAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtgtcagaatccatggga

SEQ ID NO: 1110 - DNA, 18 bp, synthetic construct
  misc_feature 1..18: note = Description of sequence: modified hamster DNA tageting: SEQ ID 398(TCTTCCCATGGATTCTGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcagaatccatgggaaga

SEQ ID NO: 1111 - DNA, 18 bp, synthetic construct
  misc_feature 1..18: note = Description of sequence: modified hamster DNA tageting: SEQ ID 399(ACATCTTCCCATGGATTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gaatccatgggaagatgt

SEQ ID NO: 1112 - DNA, 18 bp, synthetic construct
  misc_feature 1..18: note = Description of sequence: modified hamster DNA tageting: SEQ ID 400(AGAACATCTTCCCATGGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tccatgggaagatgttct

SEQ ID NO: 1113 - DNA, 18 bp, synthetic construct
  misc_feature 1..18: note = Description of sequence: modified hamster DNA tageting: SEQ ID 401(CCCAGAACATCTTCCCAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atgggaagatgttctggg

SEQ ID NO: 1114 - DNA, 18 bp, synthetic construct
  misc_feature 1..18: note = Description of sequence: modified hamster DNA tageting: SEQ ID 402(CTCCCCAGAACATCTTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggaagatgttctggggag

SEQ ID NO: 1115 - DNA, 18 bp, synthetic construct
  misc_feature 1..18: note = Description of sequence: modified hamster DNA tageting: SEQ ID 403(CACCTCCCCAGAACATCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agatgttctggggaggtg

SEQ ID NO: 1116 - DNA, 18 bp, synthetic construct
  misc_feature 1..18: note = Description of sequence: modified hamster DNA tageting: SEQ ID 404(TGTCACCTCCCCAGAACA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgttctggggaggtgaca

SEQ ID NO: 1117 - DNA, 18 bp, synthetic construct
  misc_feature 1..18: note = Description of sequence: modified hamster DNA tageting: SEQ ID 405(AGTTGTCACCTCCCCAGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tctggggaggtgacaact

SEQ ID NO: 1118 - DNA, 18 bp, synthetic construct
  misc_feature 1..18: note = Description of sequence: modified hamster DNA tageting: SEQ ID 406(CCCAGTTGTCACCTCCCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggggaggtgacaactggg

SEQ ID NO: 1119 - DNA, 18 bp, synthetic construct
  misc_feature 1..18: note = Description of sequence: modified hamster DNA tageting: SEQ ID 407(AGGCCCAGTTGTCACCTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gaggtgacaactgggcct

SEQ ID NO: 1120 - DNA, 18 bp, synthetic construct
  misc_feature 1..18: note = Description of sequence: modified hamster DNA tageting: SEQ ID 408(TGCAGGCCCAGTTGTCAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtgacaactgggcctgca

SEQ ID NO: 1121 - DNA, 18 bp, synthetic construct
  misc_feature 1..18: note = Description of sequence: modified hamster DNA tageting: SEQ ID 409(AGGTGCAGGCCCAGTTGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
acaactgggcctgcacct

SEQ ID NO: 1122 - DNA, 18 bp, synthetic construct
  misc_feature 1..18: note = Description of sequence: modified hamster DNA tageting: SEQ ID 410(AGCAGGTGCAGGCCCAGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
actgggcctgcacctgct

SEQ ID NO: 1123 - DNA, 18 bp, synthetic construct
  misc_feature 1..18: note = Description of sequence: modified hamster DNA tageting: SEQ ID 411(TGCAGCAGGTGCAGGCCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gggcctgcacctgctgca

SEQ ID NO: 1124 - DNA, 18 bp, synthetic construct
  misc_feature 1..18: note = Description of sequence: modified hamster DNA tageting: SEQ ID 412(CTCTGCAGCAGGTGCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cctgcacctgctgcagag

SEQ ID NO: 1125 - DNA, 18 bp, synthetic construct
  misc_feature 1..18: note = Description of sequence: modified hamster DNA tageting: SEQ ID 413(CACCTCTGCAGCAGGTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gcacctgctgcagaggtg

SEQ ID NO: 1126 - DNA, 18 bp, synthetic construct
  misc_feature 1..18: note = Description of sequence: modified hamster DNA tageting: SEQ ID 414(GTGCACCTCTGCAGCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cctgctgcagaggtgcac

SEQ ID NO: 1127 - DNA, 18 bp, synthetic construct
  misc_feature 1..18: note = Description of sequence: modified hamster DNA tageting: SEQ ID 415(TACGTGCACCTCTGCAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gctgcagaggtgcacgta

SEQ ID NO: 1128 - DNA, 18 bp, synthetic construct
  misc_feature 1..18: note = Description of sequence: modified hamster DNA tageting: SEQ ID 416(GACTACGTGCACCTCTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcagaggtgcacgtagtc

SEQ ID NO: 1129 - DNA, 18 bp, synthetic construct
  misc_feature 1..18: note = Description of sequence: modified hamster DNA tageting: SEQ ID 417(TCAGACTACGTGCACCTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaggtgcacgtagtctga

SEQ ID NO: 1130 - DNA, 18 bp, synthetic construct
  misc_feature 1..18: note = Description of sequence: modified hamster DNA tageting: SEQ ID 418(CACTCAGACTACGTGCAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtgcacgtagtctgagtg

SEQ ID NO: 1131 - DNA, 18 bp, synthetic construct
  misc_feature 1..18: note = Description of sequence: modified hamster DNA tageting: SEQ ID 419(CAGCACTCAGACTACGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cacgtagtctgagtgctg

SEQ ID NO: 1132 - DNA, 18 bp, synthetic construct
  misc_feature 1..18: note = Description of sequence: modified hamster DNA tageting: SEQ ID 420(CCGCAGCACTCAGACTAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtagtctgagtgctgcgg

SEQ ID NO: 1133 - DNA, 18 bp, synthetic construct
  misc_feature 1..18: note = Description of sequence: modified hamster DNA tageting: SEQ ID 421(AGTCCGCAGCACTCAGAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gtctgagtgctgcggact

SEQ ID NO: 1134 - DNA, 18 bp, synthetic construct
  misc_feature 1..18: note = Description of sequence: modified hamster DNA tageting: SEQ ID 422(CTGAGTCCGCAGCACTCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  modified_base 10: mod_base = m5c
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tgagtgctgcggactcag

SEQ ID NO: 1135 - DNA, 18 bp, synthetic construct
  misc_feature 1..18: note = Description of sequence: modified hamster DNA tageting: SEQ ID 423(CTGCTGAGTCCGCAGCAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  modified_base 7: mod_base = m5c
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtgctgcggactcagcag

SEQ ID NO: 1136 - DNA, 18 bp, synthetic construct
  misc_feature 1..18: note = Description of sequence: modified hamster DNA tageting: SEQ ID 424(GGTCTGCTGAGTCCGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  modified_base 4: mod_base = m5c
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctgcggactcagcagacc

SEQ ID NO: 1137 - DNA, 18 bp, synthetic construct
  misc_feature 1..18: note = Description of sequence: modified hamster DNA tageting: SEQ ID 425(CCGGGTCTGCTGAGTCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cggactcagcagacccgg

SEQ ID NO: 1138 - DNA, 18 bp, synthetic construct
  misc_feature 1..18: note = Description of sequence: modified hamster DNA tageting: SEQ ID 426(TGGCCGGGTCTGCTGAGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
actcagcagacccggcca

SEQ ID NO: 1139 - DNA, 18 bp, synthetic construct
  misc_feature 1..18: note = Description of sequence: modified hamster DNA tageting: SEQ ID 427(CGGTGGCCGGGTCTGCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cagcagacccggccaccg

SEQ ID NO: 1140 - DNA, 18 bp, synthetic construct
  misc_feature 1..18: note = Description of sequence: modified hamster DNA tageting: SEQ ID 428(GGCCGGTGGCCGGGTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cagacccggccaccggcc

SEQ ID NO: 1141 - DNA, 18 bp, synthetic construct
  misc_feature 1..18: note = Description of sequence: modified hamster DNA tageting: SEQ ID 429(TAAGGCCGGTGGCCGGGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
acccggccaccggcctta

SEQ ID NO: 1142 - DNA, 18 bp, synthetic construct
  misc_feature 1..18: note = Description of sequence: modified hamster DNA tageting: SEQ ID 430(GAGTAAGGCCGGTGGCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cggccaccggccttactc

SEQ ID NO: 1143 - DNA, 18 bp, synthetic construct
  misc_feature 1..18: note = Description of sequence: modified hamster DNA tageting: SEQ ID 431(ATGGAGTAAGGCCGGTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccaccggccttactccat

SEQ ID NO: 1144 - DNA, 18 bp, synthetic construct
  misc_feature 1..18: note = Description of sequence: modified hamster DNA tageting: SEQ ID 432(GAAATGGAGTAAGGCCGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 2: mod_base = m5c
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ccggccttactccatttc

SEQ ID NO: 1145 - DNA, 18 bp, synthetic construct
  misc_feature 1..18: note = Description of sequence: modified hamster DNA tageting: SEQ ID 433(AGGGAAATGGAGTAAGGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gccttactccatttccct

SEQ ID NO: 1146 - DNA, 18 bp, synthetic construct
  misc_feature 1..18: note = Description of sequence: modified hamster DNA tageting: SEQ ID 434(TCCAGGGAAATGGAGTAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ttactccatttccctgga

SEQ ID NO: 1147 - DNA, 18 bp, synthetic construct
  misc_feature 1..18: note = Description of sequence: modified hamster DNA tageting: SEQ ID 435(CCTTCCAGGGAAATGGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctccatttccctggaagg

SEQ ID NO: 1148 - DNA, 18 bp, synthetic construct
  misc_feature 1..18: note = Description of sequence: modified hamster DNA tageting: SEQ ID 436(TTTCCTTCCAGGGAAATG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
catttccctggaaggaaa

SEQ ID NO: 1149 - DNA, 18 bp, synthetic construct
  misc_feature 1..18: note = Description of sequence: modified hamster DNA tageting: SEQ ID 437(GTCTTTCCTTCCAGGGAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttccctggaaggaaagac

SEQ ID NO: 1150 - DNA, 18 bp, synthetic construct
  misc_feature 1..18: note = Description of sequence: modified hamster DNA tageting: SEQ ID 438(TTGGTCTTTCCTTCCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cctggaaggaaagaccaa

SEQ ID NO: 1151 - DNA, 18 bp, synthetic construct
  misc_feature 1..18: note = Description of sequence: modified hamster DNA tageting: SEQ ID 439(ACTTTGGTCTTTCCTTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggaaggaaagaccaaagt

SEQ ID NO: 1152 - DNA, 18 bp, synthetic construct
  misc_feature 1..18: note = Description of sequence: modified hamster DNA tageting: SEQ ID 440(CTCACTTTGGTCTTTCCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggaaagaccaaagtgag

SEQ ID NO: 1153 - DNA, 18 bp, synthetic construct
  misc_feature 1..18: note = Description of sequence: modified hamster DNA tageting: SEQ ID 441(TCCCTCACTTTGGTCTTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aaagaccaaagtgaggga

SEQ ID NO: 1154 - DNA, 18 bp, synthetic construct
  misc_feature 1..18: note = Description of sequence: modified hamster DNA tageting: SEQ ID 442(TGTTCCCTCACTTTGGTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaccaaagtgagggaaca

SEQ ID NO: 1155 - DNA, 18 bp, synthetic construct
  misc_feature 1..18: note = Description of sequence: modified hamster DNA tageting: SEQ ID 443(GAGTGTTCCCTCACTTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
caaagtgagggaacactc

SEQ ID NO: 1156 - DNA, 18 bp, synthetic construct
  misc_feature 1..18: note = Description of sequence: modified hamster DNA tageting: SEQ ID 444(TTGGAGTGTTCCCTCACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtgagggaacactccaa

SEQ ID NO: 1157 - DNA, 18 bp, synthetic construct
  misc_feature 1..18: note = Description of sequence: modified hamster DNA tageting: SEQ ID 445(TCCTTGGAGTGTTCCCTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gagggaacactccaagga

SEQ ID NO: 1158 - DNA, 18 bp, synthetic construct
  misc_feature 1..18: note = Description of sequence: modified hamster DNA tageting: SEQ ID 446(ATTTCCTTGGAGTGTTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggaacactccaaggaaat

SEQ ID NO: 1159 - DNA, 18 bp, synthetic construct
  misc_feature 1..18: note = Description of sequence: modified hamster DNA tageting: SEQ ID 447(TGCATTTCCTTGGAGTGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
acactccaaggaaatgca

SEQ ID NO: 1160 - DNA, 18 bp, synthetic construct
  misc_feature 1..18: note = Description of sequence: modified hamster DNA tageting: SEQ ID 448(GTGTGCATTTCCTTGGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctccaaggaaatgcacac

SEQ ID NO: 1161 - DNA, 18 bp, synthetic construct
  misc_feature 1..18: note = Description of sequence: modified hamster DNA tageting: SEQ ID 449(CTGGTGTGCATTTCCTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
caaggaaatgcacaccag

SEQ ID NO: 1162 - DNA, 18 bp, synthetic construct
  misc_feature 1..18: note = Description of sequence: modified hamster DNA tageting: SEQ ID 450(AGCCTGGTGTGCATTTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggaaatgcacaccaggct

SEQ ID NO: 1163 - DNA, 18 bp, synthetic construct
  misc_feature 1..18: note = Description of sequence: modified hamster DNA tageting: SEQ ID 451(CATAGCCTGGTGTGCATT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aatgcacaccaggctatg

SEQ ID NO: 1164 - DNA, 18 bp, synthetic construct
  misc_feature 1..18: note = Description of sequence: modified hamster DNA tageting: SEQ ID 452(TCCCATAGCCTGGTGTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gcacaccaggctatggga

SEQ ID NO: 1165 - DNA, 18 bp, synthetic construct
  misc_feature 1..18: note = Description of sequence: modified hamster DNA tageting: SEQ ID 453(ACCTCCCATAGCCTGGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caccaggctatgggaggt

SEQ ID NO: 1166 - DNA, 18 bp, synthetic construct
  misc_feature 1..18: note = Description of sequence: modified hamster DNA tageting: SEQ ID 454(GCCACCTCCCATAGCCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
caggctatgggaggtggc

SEQ ID NO: 1167 - DNA, 18 bp, synthetic construct
  misc_feature 1..18: note = Description of sequence: modified hamster DNA tageting: SEQ ID 455(TGAGCCACCTCCCATAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gctatgggaggtggctca

SEQ ID NO: 1168 - DNA, 18 bp, synthetic construct
  misc_feature 1..18: note = Description of sequence: modified hamster DNA tageting: SEQ ID 456(CTCTGAGCCACCTCCCAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atgggaggtggctcagag

SEQ ID NO: 1169 - DNA, 18 bp, synthetic construct
  misc_feature 1..18: note = Description of sequence: modified hamster DNA tageting: SEQ ID 457(ATGCTCTGAGCCACCTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggaggtggctcagagcat

SEQ ID NO: 1170 - DNA, 18 bp, synthetic construct
  misc_feature 1..18: note = Description of sequence: modified hamster DNA tageting: SEQ ID 458(CTTATGCTCTGAGCCACC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggtggctcagagcataag

SEQ ID NO: 1171 - DNA, 18 bp, synthetic construct
  misc_feature 1..18: note = Description of sequence: modified hamster DNA tageting: SEQ ID 459(AGGCTTATGCTCTGAGCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggctcagagcataagcct

SEQ ID NO: 1172 - DNA, 18 bp, synthetic construct
  misc_feature 1..18: note = Description of sequence: modified hamster DNA tageting: SEQ ID 460(AGCAGGCTTATGCTCTGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tcagagcataagcctgct

SEQ ID NO: 1173 - DNA, 18 bp, synthetic construct
  misc_feature 1..18: note = Description of sequence: modified hamster DNA tageting: SEQ ID 461(ACAAGCAGGCTTATGCTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gagcataagcctgcttgt

SEQ ID NO: 1174 - DNA, 18 bp, synthetic construct
  misc_feature 1..18: note = Description of sequence: modified hamster DNA tageting: SEQ ID 462(CTAACAAGCAGGCTTATG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cataagcctgcttgttag

SEQ ID NO: 1175 - DNA, 18 bp, synthetic construct
  misc_feature 1..18: note = Description of sequence: modified hamster DNA tageting: SEQ ID 463(TGCCTAACAAGCAGGCTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aagcctgcttgttaggca

SEQ ID NO: 1176 - DNA, 18 bp, synthetic construct
  misc_feature 1..18: note = Description of sequence: modified hamster DNA tageting: SEQ ID 464(GCTTGCCTAACAAGCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cctgcttgttaggcaagc

SEQ ID NO: 1177 - DNA, 18 bp, synthetic construct
  misc_feature 1..18: note = Description of sequence: modified hamster DNA tageting: SEQ ID 465(GATGCTTGCCTAACAAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcttgttaggcaagcatc

SEQ ID NO: 1178 - DNA, 18 bp, synthetic construct
  misc_feature 1..18: note = Description of sequence: modified hamster DNA tageting: SEQ ID 466(ATTGATGCTTGCCTAACA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgttaggcaagcatcaat

SEQ ID NO: 1179 - DNA, 18 bp, synthetic construct
  misc_feature 1..18: note = Description of sequence: modified hamster DNA tageting: SEQ ID 467(TACATTGATGCTTGCCTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
taggcaagcatcaatgta

SEQ ID NO: 1180 - DNA, 18 bp, synthetic construct
  misc_feature 1..18: note = Description of sequence: modified hamster DNA tageting: SEQ ID 468(TTTTACATTGATGCTTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA 5-methyl cytosine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gcaagcatcaatgtaaaa

SEQ ID NO: 1181 - DNA, 18 bp, synthetic construct
  misc_feature 1..18: note = Description of sequence: modified hamster DNA tageting: SEQ ID 469(AAATTTTACATTGATGCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA thymine nucleosid
  misc_feature 16: note = Backbone sugar is not deoxyribose e
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agcatcaatgtaaaattt

SEQ ID NO: 1182 - DNA, 18 bp, synthetic construct
  misc_feature 1..18: note = Description of sequence: modified hamster DNA tageting: SEQ ID 470(TCCAAATTTTACATTGAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
atcaatgtaaaatttgga

SEQ ID NO: 1183 - DNA, 18 bp, synthetic construct
  misc_feature 1..18: note = Description of sequence: modified hamster DNA tageting: SEQ ID 471(TGCTCCAAATTTTACATT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aatgtaaaatttggagca

SEQ ID NO: 1184 - DNA, 18 bp, synthetic construct
  misc_feature 1..18: note = Description of sequence: modified hamster DNA tageting: SEQ ID 472(TCATGCTCCAAATTTTAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA thymine nucleosid
  misc_feature 16: note = Backbone sugar is not deoxyribose e
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtaaaatttggagcatga

SEQ ID NO: 1185 - DNA, 18 bp, synthetic construct
  misc_feature 1..18: note = Description of sequence: modified hamster DNA tageting: SEQ ID 473(CTGTCATGCTCCAAATTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA 5-methyl cytosine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aaatttggagcatgacag

SEQ ID NO: 1186 - DNA, 18 bp, synthetic construct
  misc_feature 1..18: note = Description of sequence: modified hamster DNA tageting: SEQ ID 474(CAACTGTCATGCTCCAAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tttggagcatgacagttg

SEQ ID NO: 1187 - DNA, 18 bp, synthetic construct
  misc_feature 1..18: note = Description of sequence: modified hamster DNA tageting: SEQ ID 475(GCACAACTGTCATGCTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggagcatgacagttgtgc

SEQ ID NO: 1188 - DNA, 18 bp, synthetic construct
  misc_feature 1..18: note = Description of sequence: modified hamster DNA tageting: SEQ ID 476(CAGGCACAACTGTCATGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gcatgacagttgtgcctg

SEQ ID NO: 1189 - DNA, 18 bp, synthetic construct
  misc_feature 1..18: note = Description of sequence: modified hamster DNA tageting: SEQ ID 477(ATACAGGCACAACTGTCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgacagttgtgcctgtat

SEQ ID NO: 1190 - DNA, 18 bp, synthetic construct
  misc_feature 1..18: note = Description of sequence: modified hamster DNA tageting: SEQ ID 478(GTTATACAGGCACAACTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cagttgtgcctgtataac

SEQ ID NO: 1191 - DNA, 18 bp, synthetic construct
  misc_feature 1..18: note = Description of sequence: modified hamster DNA tageting: SEQ ID 479(GGGGTTATACAGGCACAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttgtgcctgtataacccc

SEQ ID NO: 1192 - DNA, 18 bp, synthetic construct
  misc_feature 1..18: note = Description of sequence: modified hamster DNA tageting: SEQ ID 480(GTTGGGGTTATACAGGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgcctgtataaccccaac

SEQ ID NO: 1193 - DNA, 18 bp, synthetic construct
  misc_feature 1..18: note = Description of sequence: modified hamster DNA tageting: SEQ ID 481(AGTGTTGGGGTTATACAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ctgtataaccccaacact

SEQ ID NO: 1194 - DNA, 18 bp, synthetic construct
  misc_feature 1..18: note = Description of sequence: modified hamster DNA tageting: SEQ ID 482(CTCAGTGTTGGGGTTATA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tataaccccaacactgag

SEQ ID NO: 1195 - DNA, 18 bp, synthetic construct
  misc_feature 1..18: note = Description of sequence: modified hamster DNA tageting: SEQ ID 483(TCCCTCAGTGTTGGGGTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aaccccaacactgaggga

SEQ ID NO: 1196 - DNA, 18 bp, synthetic construct
  misc_feature 1..18: note = Description of sequence: modified hamster DNA tageting: SEQ ID 484(ACTCCGAGGTAGAGCTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caagctctacctcggagt

SEQ ID NO: 1197 - DNA, 18 bp, synthetic construct
  misc_feature 1..18: note = Description of sequence: modified hamster DNA tageting: SEQ ID 485(GACTCCGAGGTAGAGCTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  modified_base 12: mod_base = m5c
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aagctctacctcggagtc

SEQ ID NO: 1198 - DNA, 18 bp, synthetic construct
  misc_feature 1..18: note = Description of sequence: modified hamster DNA tageting: SEQ ID 486(CAGACTCCGAGGTAGAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  modified_base 10: mod_base = m5c
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gctctacctcggagtctg

SEQ ID NO: 1199 - DNA, 18 bp, synthetic construct
  misc_feature 1..18: note = Description of sequence: modified hamster DNA tageting: SEQ ID 487(TCAGACTCCGAGGTAGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctctacctcggagtctga

SEQ ID NO: 1200 - DNA, 18 bp, synthetic construct
  misc_feature 1..18: note = Description of sequence: modified hamster DNA tageting: SEQ ID 488(CTTCAGACTCCGAGGTAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctacctcggagtctgaag

SEQ ID NO: 1201 - DNA, 18 bp, synthetic construct
  misc_feature 1..18: note = Description of sequence: modified hamster DNA tageting: SEQ ID 489(TCTTCAGACTCCGAGGTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  modified_base 6: mod_base = m5c
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tacctcggagtctgaaga

SEQ ID NO: 1202 - DNA, 18 bp, synthetic construct
  misc_feature 1..18: note = Description of sequence: modified hamster DNA tageting: SEQ ID 490(ACTCTTCAGACTCCGAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
cctcggagtctgaagagt

SEQ ID NO: 1203 - DNA, 18 bp, synthetic construct
  misc_feature 1..18: note = Description of sequence: modified hamster DNA tageting: SEQ ID 491(GACTCTTCAGACTCCGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = m5c
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctcggagtctgaagagtc

SEQ ID NO: 1204 - DNA, 18 bp, synthetic construct
  misc_feature 1..18: note = Description of sequence: modified hamster DNA tageting: SEQ ID 492(TTGACTCTTCAGACTCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cggagtctgaagagtcaa

SEQ ID NO: 1205 - DNA, 18 bp, synthetic construct
  misc_feature 1..18: note = Description of sequence: modified hamster DNA tageting: SEQ ID 493(GTTGACTCTTCAGACTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggagtctgaagagtcaac

SEQ ID NO: 1206 - DNA, 18 bp, synthetic construct
  misc_feature 1..18: note = Description of sequence: modified hamster DNA tageting: SEQ ID 494(CTGTTGACTCTTCAGACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agtctgaagagtcaacag

SEQ ID NO: 1207 - DNA, 18 bp, synthetic construct
  misc_feature 1..18: note = Description of sequence: modified hamster DNA tageting: SEQ ID 495(ACTGTTGACTCTTCAGAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gtctgaagagtcaacagt

SEQ ID NO: 1208 - DNA, 18 bp, synthetic construct
  misc_feature 1..18: note = Description of sequence: modified hamster DNA tageting: SEQ ID 496(ACACTGTTGACTCTTCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ctgaagagtcaacagtgt

SEQ ID NO: 1209 - DNA, 18 bp, synthetic construct
  misc_feature 1..18: note = Description of sequence: modified hamster DNA tageting: SEQ ID 497(GACACTGTTGACTCTTCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgaagagtcaacagtgtc

SEQ ID NO: 1210 - DNA, 18 bp, synthetic construct
  misc_feature 1..18: note = Description of sequence: modified hamster DNA tageting: SEQ ID 498(CTGACACTGTTGACTCTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aagagtcaacagtgtcag

SEQ ID NO: 1211 - DNA, 18 bp, synthetic construct
  misc_feature 1..18: note = Description of sequence: modified hamster DNA tageting: SEQ ID 499(TCTGACACTGTTGACTCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agagtcaacagtgtcaga

SEQ ID NO: 1212 - DNA, 18 bp, synthetic construct
  misc_feature 1..18: note = Description of sequence: modified hamster DNA tageting: SEQ ID 500(ATTCTGACACTGTTGACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agtcaacagtgtcagaat

SEQ ID NO: 1213 - DNA, 18 bp, synthetic construct
  misc_feature 1..18: note = Description of sequence: modified hamster DNA tageting: SEQ ID 501(GATTCTGACACTGTTGAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gtcaacagtgtcagaatc

SEQ ID NO: 1214 - DNA, 18 bp, synthetic construct
  misc_feature 1..18: note = Description of sequence: modified hamster DNA tageting: SEQ ID 502(TGGATTCTGACACTGTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
caacagtgtcagaatcca

SEQ ID NO: 1215 - DNA, 18 bp, synthetic construct
  misc_feature 1..18: note = Description of sequence: modified hamster DNA tageting: SEQ ID 503(ATGGATTCTGACACTGTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
aacagtgtcagaatccat

SEQ ID NO: 1216 - DNA, 18 bp, synthetic construct
  misc_feature 1..18: note = Description of sequence: modified hamster DNA tageting: SEQ ID 504(CCATGGATTCTGACACTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cagtgtcagaatccatgg

SEQ ID NO: 1217 - DNA, 18 bp, synthetic construct
  misc_feature 1..18: note = Description of sequence: modified hamster DNA tageting: SEQ ID 505(CCCATGGATTCTGACACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agtgtcagaatccatggg

SEQ ID NO: 1218 - DNA, 18 bp, synthetic construct
  misc_feature 1..18: note = Description of sequence: modified hamster DNA tageting: SEQ ID 506(TTCCCATGGATTCTGACA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgtcagaatccatgggaa

SEQ ID NO: 1219 - DNA, 18 bp, synthetic construct
  misc_feature 1..18: note = Description of sequence: modified hamster DNA tageting: SEQ ID 507(CTTCCCATGGATTCTGAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtcagaatccatgggaag

SEQ ID NO: 1220 - DNA, 18 bp, synthetic construct
  misc_feature 1..18: note = Description of sequence: modified hamster DNA tageting: SEQ ID 508(ATCTTCCCATGGATTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
cagaatccatgggaagat

SEQ ID NO: 1221 - DNA, 18 bp, synthetic construct
  misc_feature 1..18: note = Description of sequence: modified hamster DNA tageting: SEQ ID 509(CATCTTCCCATGGATTCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agaatccatgggaagatg

SEQ ID NO: 1222 - DNA, 18 bp, synthetic construct
  misc_feature 1..18: note = Description of sequence: modified hamster DNA tageting: SEQ ID 510(AACATCTTCCCATGGATT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
aatccatgggaagatgtt

SEQ ID NO: 1223 - DNA, 18 bp, synthetic construct
  misc_feature 1..18: note = Description of sequence: modified hamster DNA tageting: SEQ ID 511(GAACATCTTCCCATGGAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atccatgggaagatgttc

SEQ ID NO: 1224 - DNA, 18 bp, synthetic construct
  misc_feature 1..18: note = Description of sequence: modified hamster DNA tageting: SEQ ID 512(CAGAACATCTTCCCATGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ccatgggaagatgttctg

SEQ ID NO: 1225 - DNA, 18 bp, synthetic construct
  misc_feature 1..18: note = Description of sequence: modified hamster DNA tageting: SEQ ID 513(CCAGAACATCTTCCCATG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
catgggaagatgttctgg

SEQ ID NO: 1226 - DNA, 18 bp, synthetic construct
  misc_feature 1..18: note = Description of sequence: modified hamster DNA tageting: SEQ ID 514(CCCCAGAACATCTTCCCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tgggaagatgttctgggg

SEQ ID NO: 1227 - DNA, 18 bp, synthetic construct
  misc_feature 1..18: note = Description of sequence: modified hamster DNA tageting: SEQ ID 515(TCCCCAGAACATCTTCCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gggaagatgttctgggga

SEQ ID NO: 1228 - DNA, 18 bp, synthetic construct
  misc_feature 1..18: note = Description of sequence: modified hamster DNA tageting: SEQ ID 516(CCTCCCCAGAACATCTTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gaagatgttctggggagg

SEQ ID NO: 1229 - DNA, 18 bp, synthetic construct
  misc_feature 1..18: note = Description of sequence: modified hamster DNA tageting: SEQ ID 517(ACCTCCCCAGAACATCTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
aagatgttctggggaggt

SEQ ID NO: 1230 - DNA, 18 bp, synthetic construct
  misc_feature 1..18: note = Description of sequence: modified hamster DNA tageting: SEQ ID 518(TCACCTCCCCAGAACATC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gatgttctggggaggtga

SEQ ID NO: 1231 - DNA, 18 bp, synthetic construct
  misc_feature 1..18: note = Description of sequence: modified hamster DNA tageting: SEQ ID 519(GTCACCTCCCCAGAACAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atgttctggggaggtgac

SEQ ID NO: 1232 - DNA, 18 bp, synthetic construct
  misc_feature 1..18: note = Description of sequence: modified hamster DNA tageting: SEQ ID 520(TTGTCACCTCCCCAGAAC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gttctggggaggtgacaa

SEQ ID NO: 1233 - DNA, 18 bp, synthetic construct
  misc_feature 1..18: note = Description of sequence: modified hamster DNA tageting: SEQ ID 521(GTTGTCACCTCCCCAGAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttctggggaggtgacaac

SEQ ID NO: 1234 - DNA, 18 bp, synthetic construct
  misc_feature 1..18: note = Description of sequence: modified hamster DNA tageting: SEQ ID 522(CAGTTGTCACCTCCCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctggggaggtgacaactg

SEQ ID NO: 1235 - DNA, 18 bp, synthetic construct
  misc_feature 1..18: note = Description of sequence: modified hamster DNA tageting: SEQ ID 523(CCAGTTGTCACCTCCCCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tggggaggtgacaactgg

SEQ ID NO: 1236 - DNA, 18 bp, synthetic construct
  misc_feature 1..18: note = Description of sequence: modified hamster DNA tageting: SEQ ID 524(GCCCAGTTGTCACCTCCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gggaggtgacaactgggc

SEQ ID NO: 1237 - DNA, 18 bp, synthetic construct
  misc_feature 1..18: note = Description of sequence: modified hamster DNA tageting: SEQ ID 525(GGCCCAGTTGTCACCTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggaggtgacaactgggcc

SEQ ID NO: 1238 - DNA, 18 bp, synthetic construct
  misc_feature 1..18: note = Description of sequence: modified hamster DNA tageting: SEQ ID 526(CAGGCCCAGTTGTCACCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggtgacaactgggcctg

SEQ ID NO: 1239 - DNA, 18 bp, synthetic construct
  misc_feature 1..18: note = Description of sequence: modified hamster DNA tageting: SEQ ID 527(GCAGGCCCAGTTGTCACC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggtgacaactgggcctgc

SEQ ID NO: 1240 - DNA, 18 bp, synthetic construct
  misc_feature 1..18: note = Description of sequence: modified hamster DNA tageting: SEQ ID 528(GTGCAGGCCCAGTTGTCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgacaactgggcctgcac

SEQ ID NO: 1241 - DNA, 18 bp, synthetic construct
  misc_feature 1..18: note = Description of sequence: modified hamster DNA tageting: SEQ ID 529(GGTGCAGGCCCAGTTGTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gacaactgggcctgcacc

SEQ ID NO: 1242 - DNA, 18 bp, synthetic construct
  misc_feature 1..18: note = Description of sequence: modified hamster DNA tageting: SEQ ID 530(CAGGTGCAGGCCCAGTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
caactgggcctgcacctg

SEQ ID NO: 1243 - DNA, 18 bp, synthetic construct
  misc_feature 1..18: note = Description of sequence: modified hamster DNA tageting: SEQ ID 531(GCAGGTGCAGGCCCAGTT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aactgggcctgcacctgc

SEQ ID NO: 1244 - DNA, 18 bp, synthetic construct
  misc_feature 1..18: note = Description of sequence: modified hamster DNA tageting: SEQ ID 532(CAGCAGGTGCAGGCCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgggcctgcacctgctg

SEQ ID NO: 1245 - DNA, 18 bp, synthetic construct
  misc_feature 1..18: note = Description of sequence: modified hamster DNA tageting: SEQ ID 533(GCAGCAGGTGCAGGCCCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgggcctgcacctgctgc

SEQ ID NO: 1246 - DNA, 18 bp, synthetic construct
  misc_feature 1..18: note = Description of sequence: modified hamster DNA tageting: SEQ ID 534(CTGCAGCAGGTGCAGGCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggcctgcacctgctgcag

SEQ ID NO: 1247 - DNA, 18 bp, synthetic construct
  misc_feature 1..18: note = Description of sequence: modified hamster DNA tageting: SEQ ID 535(TCTGCAGCAGGTGCAGGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gcctgcacctgctgcaga

SEQ ID NO: 1248 - DNA, 18 bp, synthetic construct
  misc_feature 1..18: note = Description of sequence: modified hamster DNA tageting: SEQ ID 536(CCTCTGCAGCAGGTGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgcacctgctgcagagg

SEQ ID NO: 1249 - DNA, 18 bp, synthetic construct
  misc_feature 1..18: note = Description of sequence: modified hamster DNA tageting: SEQ ID 537(ACCTCTGCAGCAGGTGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgcacctgctgcagaggt

SEQ ID NO: 1250 - DNA, 18 bp, synthetic construct
  misc_feature 1..18: note = Description of sequence: modified hamster DNA tageting: SEQ ID 538(GCACCTCTGCAGCAGGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cacctgctgcagaggtgc

SEQ ID NO: 1251 - DNA, 18 bp, synthetic construct
  misc_feature 1..18: note = Description of sequence: modified hamster DNA tageting: SEQ ID 539(TGCACCTCTGCAGCAGGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
acctgctgcagaggtgca

SEQ ID NO: 1252 - DNA, 18 bp, synthetic construct
  misc_feature 1..18: note = Description of sequence: modified hamster DNA tageting: SEQ ID 540(CGTGCACCTCTGCAGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgctgcagaggtgcacg

SEQ ID NO: 1253 - DNA, 18 bp, synthetic construct
  misc_feature 1..18: note = Description of sequence: modified hamster DNA tageting: SEQ ID 541(ACGTGCACCTCTGCAGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgctgcagaggtgcacgt

SEQ ID NO: 1254 - DNA, 18 bp, synthetic construct
  misc_feature 1..18: note = Description of sequence: modified hamster DNA tageting: SEQ ID 542(CTACGTGCACCTCTGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgcagaggtgcacgtag

SEQ ID NO: 1255 - DNA, 18 bp, synthetic construct
  misc_feature 1..18: note = Description of sequence: modified hamster DNA tageting: SEQ ID 543(ACTACGTGCACCTCTGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgcagaggtgcacgtagt

SEQ ID NO: 1256 - DNA, 18 bp, synthetic construct
  misc_feature 1..18: note = Description of sequence: modified hamster DNA tageting: SEQ ID 544(AGACTACGTGCACCTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
cagaggtgcacgtagtct

SEQ ID NO: 1257 - DNA, 18 bp, synthetic construct
  misc_feature 1..18: note = Description of sequence: modified hamster DNA tageting: SEQ ID 545(CAGACTACGTGCACCTCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  modified_base 10: mod_base = m5c
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agaggtgcacgtagtctg

SEQ ID NO: 1258 - DNA, 18 bp, synthetic construct
  misc_feature 1..18: note = Description of sequence: modified hamster DNA tageting: SEQ ID 546(CTCAGACTACGTGCACCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggtgcacgtagtctgag

SEQ ID NO: 1259 - DNA, 18 bp, synthetic construct
  misc_feature 1..18: note = Description of sequence: modified hamster DNA tageting: SEQ ID 547(ACTCAGACTACGTGCACC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggtgcacgtagtctgagt

SEQ ID NO: 1260 - DNA, 18 bp, synthetic construct
  misc_feature 1..18: note = Description of sequence: modified hamster DNA tageting: SEQ ID 548(GCACTCAGACTACGTGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgcacgtagtctgagtgc

SEQ ID NO: 1261 - DNA, 18 bp, synthetic construct
  misc_feature 1..18: note = Description of sequence: modified hamster DNA tageting: SEQ ID 549(AGCACTCAGACTACGTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gcacgtagtctgagtgct

SEQ ID NO: 1262 - DNA, 18 bp, synthetic construct
  misc_feature 1..18: note = Description of sequence: modified hamster DNA tageting: SEQ ID 550(GCAGCACTCAGACTACGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
acgtagtctgagtgctgc

SEQ ID NO: 1263 - DNA, 18 bp, synthetic construct
  misc_feature 1..18: note = Description of sequence: modified hamster DNA tageting: SEQ ID 551(CGCAGCACTCAGACTACG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cgtagtctgagtgctgcg

SEQ ID NO: 1264 - DNA, 18 bp, synthetic construct
  misc_feature 1..18: note = Description of sequence: modified hamster DNA tageting: SEQ ID 552(TCCGCAGCACTCAGACTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tagtctgagtgctgcgga

SEQ ID NO: 1265 - DNA, 18 bp, synthetic construct
  misc_feature 1..18: note = Description of sequence: modified hamster DNA tageting: SEQ ID 553(GTCCGCAGCACTCAGACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agtctgagtgctgcggac

SEQ ID NO: 1266 - DNA, 18 bp, synthetic construct
  misc_feature 1..18: note = Description of sequence: modified hamster DNA tageting: SEQ ID 554(GAGTCCGCAGCACTCAGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  modified_base 12: mod_base = m5c
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tctgagtgctgcggactc

SEQ ID NO: 1267 - DNA, 18 bp, synthetic construct
  misc_feature 1..18: note = Description of sequence: modified hamster DNA tageting: SEQ ID 555(TGAGTCCGCAGCACTCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctgagtgctgcggactca

SEQ ID NO: 1268 - DNA, 18 bp, synthetic construct
  misc_feature 1..18: note = Description of sequence: modified hamster DNA tageting: SEQ ID 556(GCTGAGTCCGCAGCACTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  modified_base 9: mod_base = m5c
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gagtgctgcggactcagc

SEQ ID NO: 1269 - DNA, 18 bp, synthetic construct
  misc_feature 1..18: note = Description of sequence: modified hamster DNA tageting: SEQ ID 557(TGCTGAGTCCGCAGCACT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = m5c
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtgctgcggactcagca

SEQ ID NO: 1270 - DNA, 18 bp, synthetic construct
  misc_feature 1..18: note = Description of sequence: modified hamster DNA tageting: SEQ ID 558(TCTGCTGAGTCCGCAGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  modified_base 6: mod_base = m5c
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgctgcggactcagcaga

SEQ ID NO: 1271 - DNA, 18 bp, synthetic construct
  misc_feature 1..18: note = Description of sequence: modified hamster DNA tageting: SEQ ID 559(GTCTGCTGAGTCCGCAGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  modified_base 5: mod_base = m5c
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gctgcggactcagcagac

SEQ ID NO: 1272 - DNA, 18 bp, synthetic construct
  misc_feature 1..18: note = Description of sequence: modified hamster DNA tageting: SEQ ID 560(GGGTCTGCTGAGTCCGCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = m5c
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgcggactcagcagaccc

SEQ ID NO: 1273 - DNA, 18 bp, synthetic construct
  misc_feature 1..18: note = Description of sequence: modified hamster DNA tageting: SEQ ID 561(CGGGTCTGCTGAGTCCGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  modified_base 2: mod_base = m5c
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gcggactcagcagacccg

SEQ ID NO: 1274 - DNA, 18 bp, synthetic construct
  misc_feature 1..18: note = Description of sequence: modified hamster DNA tageting: SEQ ID 562(GCCGGGTCTGCTGAGTCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggactcagcagacccggc

SEQ ID NO: 1275 - DNA, 18 bp, synthetic construct
  misc_feature 1..18: note = Description of sequence: modified hamster DNA tageting: SEQ ID 563(GGCCGGGTCTGCTGAGTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gactcagcagacccggcc

SEQ ID NO: 1276 - DNA, 18 bp, synthetic construct
  misc_feature 1..18: note = Description of sequence: modified hamster DNA tageting: SEQ ID 564(GTGGCCGGGTCTGCTGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctcagcagacccggccac

SEQ ID NO: 1277 - DNA, 18 bp, synthetic construct
  misc_feature 1..18: note = Description of sequence: modified hamster DNA tageting: SEQ ID 565(GGTGGCCGGGTCTGCTGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tcagcagacccggccacc

SEQ ID NO: 1278 - DNA, 18 bp, synthetic construct
  misc_feature 1..18: note = Description of sequence: modified hamster DNA tageting: SEQ ID 566(CCGGTGGCCGGGTCTGCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agcagacccggccaccgg

SEQ ID NO: 1279 - DNA, 18 bp, synthetic construct
  misc_feature 1..18: note = Description of sequence: modified hamster DNA tageting: SEQ ID 567(GCCGGTGGCCGGGTCTGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcagacccggccaccggc

SEQ ID NO: 1280 - DNA, 18 bp, synthetic construct
  misc_feature 1..18: note = Description of sequence: modified hamster DNA tageting: SEQ ID 568(AGGCCGGTGGCCGGGTCT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agacccggccaccggcct

SEQ ID NO: 1281 - DNA, 18 bp, synthetic construct
  misc_feature 1..18: note = Description of sequence: modified hamster DNA tageting: SEQ ID 569(AAGGCCGGTGGCCGGGTC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gacccggccaccggcctt

SEQ ID NO: 1282 - DNA, 18 bp, synthetic construct
  misc_feature 1..18: note = Description of sequence: modified hamster DNA tageting: SEQ ID 570(GTAAGGCCGGTGGCCGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cccggccaccggccttac

SEQ ID NO: 1283 - DNA, 18 bp, synthetic construct
  misc_feature 1..18: note = Description of sequence: modified hamster DNA tageting: SEQ ID 571(AGTAAGGCCGGTGGCCGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccggccaccggccttact

SEQ ID NO: 1284 - DNA, 18 bp, synthetic construct
  misc_feature 1..18: note = Description of sequence: modified hamster DNA tageting: SEQ ID 572(GGAGTAAGGCCGGTGGCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggccaccggccttactcc

SEQ ID NO: 1285 - DNA, 18 bp, synthetic construct
  misc_feature 1..18: note = Description of sequence: modified hamster DNA tageting: SEQ ID 573(TGGAGTAAGGCCGGTGGC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gccaccggccttactcca

SEQ ID NO: 1286 - DNA, 18 bp, synthetic construct
  misc_feature 1..18: note = Description of sequence: modified hamster DNA tageting: SEQ ID 574(AATGGAGTAAGGCCGGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caccggccttactccatt

SEQ ID NO: 1287 - DNA, 18 bp, synthetic construct
  misc_feature 1..18: note = Description of sequence: modified hamster DNA tageting: SEQ ID 575(AAATGGAGTAAGGCCGGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
accggccttactccattt

SEQ ID NO: 1288 - DNA, 18 bp, synthetic construct
  misc_feature 1..18: note = Description of sequence: modified hamster DNA tageting: SEQ ID 576(GGAAATGGAGTAAGGCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cggccttactccatttcc

SEQ ID NO: 1289 - DNA, 18 bp, synthetic construct
  misc_feature 1..18: note = Description of sequence: modified hamster DNA tageting: SEQ ID 577(GGGAAATGGAGTAAGGCC)
  source 1..18: mol_type = other DNA
  modified_base 1: mod_base = OTHER; note = beta-D-OXY-LNA GUANINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggccttactccatttccc

SEQ ID NO: 1290 - DNA, 18 bp, synthetic construct
  misc_feature 1..18: note = Description of sequence: modified hamster DNA tageting: SEQ ID 578(CAGGGAAATGGAGTAAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ccttactccatttccctg

SEQ ID NO: 1291 - DNA, 18 bp, synthetic construct
  misc_feature 1..18: note = Description of sequence: modified hamster DNA tageting: SEQ ID 579(CCAGGGAAATGGAGTAAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cttactccatttccctgg

SEQ ID NO: 1292 - DNA, 18 bp, synthetic construct
  misc_feature 1..18: note = Description of sequence: modified hamster DNA tageting: SEQ ID 580(TTCCAGGGAAATGGAGTA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tactccatttccctggaa

SEQ ID NO: 1293 - DNA, 18 bp, synthetic construct
  misc_feature 1..18: note = Description of sequence: modified hamster DNA tageting: SEQ ID 581(CTTCCAGGGAAATGGAGT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
actccatttccctggaag

SEQ ID NO: 1294 - DNA, 18 bp, synthetic construct
  misc_feature 1..18: note = Description of sequence: modified hamster DNA tageting: SEQ ID 582(TCCTTCCAGGGAAATGGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tccatttccctggaagga

SEQ ID NO: 1295 - DNA, 18 bp, synthetic construct
  misc_feature 1..18: note = Description of sequence: modified hamster DNA tageting: SEQ ID 583(TTCCTTCCAGGGAAATGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ccatttccctggaaggaa

SEQ ID NO: 1296 - DNA, 18 bp, synthetic construct
  misc_feature 1..18: note = Description of sequence: modified hamster DNA tageting: SEQ ID 584(CTTTCCTTCCAGGGAAAT)
  source 1..18: mol_type = other DNA
  modified_base 1: mod_base = OTHER; note = beta-D-OXY-LNA ADENINE NUCLEOSIDE
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atttccctggaaggaaag

SEQ ID NO: 1297 - DNA, 18 bp, synthetic construct
  misc_feature 1..18: note = Description of sequence: modified hamster DNA tageting: SEQ ID 585(TCTTTCCTTCCAGGGAAA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tttccctggaaggaaaga

SEQ ID NO: 1298 - DNA, 18 bp, synthetic construct
  misc_feature 1..18: note = Description of sequence: modified hamster DNA tageting: SEQ ID 586(GGTCTTTCCTTCCAGGGA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tccctggaaggaaagacc

SEQ ID NO: 1299 - DNA, 18 bp, synthetic construct
  misc_feature 1..18: note = Description of sequence: modified hamster DNA tageting: SEQ ID 587(TGGTCTTTCCTTCCAGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ccctggaaggaaagacca

SEQ ID NO: 1300 - DNA, 18 bp, synthetic construct
  misc_feature 1..18: note = Description of sequence: modified hamster DNA tageting: SEQ ID 588(TTTGGTCTTTCCTTCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctggaaggaaagaccaaa

SEQ ID NO: 1301 - DNA, 18 bp, synthetic construct
  misc_feature 1..18: note = Description of sequence: modified hamster DNA tageting: SEQ ID 589(CTTTGGTCTTTCCTTCCA)
  source 1..18: mol_type = other DNA
  modified_base 1: mod_base = OTHER; note = beta-D-OXY-LNA THYMINE NUCLEOSID
  misc_feature 1: note = Backbone sugar is not deoxyribose e
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tggaaggaaagaccaaag

SEQ ID NO: 1302 - DNA, 18 bp, synthetic construct
  misc_feature 1..18: note = Description of sequence: modified mouse DNA tageting: SEQ ID 699(AGAACATCTTCCCATGGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tccatgggaagatgttct

SEQ ID NO: 1303 - DNA, 18 bp, synthetic construct
  misc_feature 1..18: note = Description of sequence: modified mouse DNA tageting: SEQ ID 700(CTCCCCAGAACATCTTCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggaagatgttctggggag

SEQ ID NO: 1304 - DNA, 18 bp, synthetic construct
  misc_feature 1..18: note = Description of sequence: modified mouse DNA tageting: SEQ ID 701(TGTCACCTCCCCAGAACA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgttctggggaggtgaca

SEQ ID NO: 1305 - DNA, 18 bp, synthetic construct
  misc_feature 1..18: note = Description of sequence: modified mouse DNA tageting: SEQ ID 702(CCCAGTTGTCACCTCCCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggggaggtgacaactggg

SEQ ID NO: 1306 - DNA, 18 bp, synthetic construct
  misc_feature 1..18: note = Description of sequence: modified mouse DNA tageting: SEQ ID 703(TGCAGGCCCAGTTGTCAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtgacaactgggcctgca

SEQ ID NO: 1307 - DNA, 18 bp, synthetic construct
  misc_feature 1..18: note = Description of sequence: modified mouse DNA tageting: SEQ ID 704(AGCAGGTGCAGGCCCAGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
actgggcctgcacctgct

SEQ ID NO: 1308 - DNA, 18 bp, synthetic construct
  misc_feature 1..18: note = Description of sequence: modified mouse DNA tageting: SEQ ID 705(CTCTGCAGCAGGTGCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cctgcacctgctgcagag

SEQ ID NO: 1309 - DNA, 18 bp, synthetic construct
  misc_feature 1..18: note = Description of sequence: modified mouse DNA tageting: SEQ ID 706(GTGCACCTCTGCAGCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cctgctgcagaggtgcac

SEQ ID NO: 1310 - DNA, 18 bp, synthetic construct
  misc_feature 1..18: note = Description of sequence: modified mouse DNA tageting: SEQ ID 707(CTGAGTCCGCAGCACTCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  modified_base 10: mod_base = m5c
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tgagtgctgcggactcag

SEQ ID NO: 1311 - DNA, 18 bp, synthetic construct
  misc_feature 1..18: note = Description of sequence: modified mouse DNA tageting: SEQ ID 708(GGTCTGCTGAGTCCGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  modified_base 4: mod_base = m5c
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctgcggactcagcagacc

SEQ ID NO: 1312 - DNA, 18 bp, synthetic construct
  misc_feature 1..18: note = Description of sequence: modified mouse DNA tageting: SEQ ID 709(TGGCCGGGTCTGCTGAGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
actcagcagacccggcca

SEQ ID NO: 1313 - DNA, 18 bp, synthetic construct
  misc_feature 1..18: note = Description of sequence: modified mouse DNA tageting: SEQ ID 710(CCAGAACATCTTCCCATG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
catgggaagatgttctgg

SEQ ID NO: 1314 - DNA, 18 bp, synthetic construct
  misc_feature 1..18: note = Description of sequence: modified mouse DNA tageting: SEQ ID 711(CCCCAGAACATCTTCCCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tgggaagatgttctgggg

SEQ ID NO: 1315 - DNA, 18 bp, synthetic construct
  misc_feature 1..18: note = Description of sequence: modified mouse DNA tageting: SEQ ID 712(ACCTCCCCAGAACATCTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
aagatgttctggggaggt

SEQ ID NO: 1316 - DNA, 18 bp, synthetic construct
  misc_feature 1..18: note = Description of sequence: modified mouse DNA tageting: SEQ ID 713(TCACCTCCCCAGAACATC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gatgttctggggaggtga

SEQ ID NO: 1317 - DNA, 18 bp, synthetic construct
  misc_feature 1..18: note = Description of sequence: modified mouse DNA tageting: SEQ ID 714(GTTGTCACCTCCCCAGAA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttctggggaggtgacaac

SEQ ID NO: 1318 - DNA, 18 bp, synthetic construct
  misc_feature 1..18: note = Description of sequence: modified mouse DNA tageting: SEQ ID 715(CAGTTGTCACCTCCCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctggggaggtgacaactg

SEQ ID NO: 1319 - DNA, 18 bp, synthetic construct
  misc_feature 1..18: note = Description of sequence: modified mouse DNA tageting: SEQ ID 716(GGCCCAGTTGTCACCTCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggaggtgacaactgggcc

SEQ ID NO: 1320 - DNA, 18 bp, synthetic construct
  misc_feature 1..18: note = Description of sequence: modified mouse DNA tageting: SEQ ID 717(CAGGCCCAGTTGTCACCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggtgacaactgggcctg

SEQ ID NO: 1321 - DNA, 18 bp, synthetic construct
  misc_feature 1..18: note = Description of sequence: modified mouse DNA tageting: SEQ ID 718(GGTGCAGGCCCAGTTGTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gacaactgggcctgcacc

SEQ ID NO: 1322 - DNA, 18 bp, synthetic construct
  misc_feature 1..18: note = Description of sequence: modified mouse DNA tageting: SEQ ID 719(CAGGTGCAGGCCCAGTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
caactgggcctgcacctg

SEQ ID NO: 1323 - DNA, 18 bp, synthetic construct
  misc_feature 1..18: note = Description of sequence: modified mouse DNA tageting: SEQ ID 720(GCAGCAGGTGCAGGCCCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgggcctgcacctgctgc

SEQ ID NO: 1324 - DNA, 18 bp, synthetic construct
  misc_feature 1..18: note = Description of sequence: modified mouse DNA tageting: SEQ ID 721(CTGCAGCAGGTGCAGGCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggcctgcacctgctgcag

SEQ ID NO: 1325 - DNA, 18 bp, synthetic construct
  misc_feature 1..18: note = Description of sequence: modified mouse DNA tageting: SEQ ID 722(GCACCTCTGCAGCAGGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cacctgctgcagaggtgc

SEQ ID NO: 1326 - DNA, 18 bp, synthetic construct
  misc_feature 1..18: note = Description of sequence: modified mouse DNA tageting: SEQ ID 723(GTCCGCAGCACTCAGACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agtctgagtgctgcggac

SEQ ID NO: 1327 - DNA, 18 bp, synthetic construct
  misc_feature 1..18: note = Description of sequence: modified mouse DNA tageting: SEQ ID 724(GAGTCCGCAGCACTCAGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  modified_base 12: mod_base = m5c
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tctgagtgctgcggactc

SEQ ID NO: 1328 - DNA, 18 bp, synthetic construct
  misc_feature 1..18: note = Description of sequence: modified mouse DNA tageting: SEQ ID 725(TGCTGAGTCCGCAGCACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  modified_base 8: mod_base = m5c
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtgctgcggactcagca

SEQ ID NO: 1329 - DNA, 18 bp, synthetic construct
  misc_feature 1..18: note = Description of sequence: modified mouse DNA tageting: SEQ ID 726(TCTGCTGAGTCCGCAGCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  modified_base 6: mod_base = m5c
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgctgcggactcagcaga

SEQ ID NO: 1330 - DNA, 18 bp, synthetic construct
  misc_feature 1..18: note = Description of sequence: modified mouse DNA tageting: SEQ ID 727(CGGGTCTGCTGAGTCCGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = m5c
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gcggactcagcagacccg

SEQ ID NO: 1331 - DNA, 18 bp, synthetic construct
  misc_feature 1..18: note = Description of sequence: modified mouse DNA tageting: SEQ ID 728(GCCGGGTCTGCTGAGTCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggactcagcagacccggc

SEQ ID NO: 1332 - DNA, 18 bp, synthetic construct
  misc_feature 1..18: note = Description of sequence: modified mouse DNA tageting: SEQ ID 729(GGTGGCCGGGTCTGCTGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tcagcagacccggccacc

SEQ ID NO: 1333 - DNA, 18 bp, synthetic construct
  misc_feature 1..18: note = Description of sequence: modified mouse DNA tageting: SEQ ID 730(CTAAGTGGCGTGTGACAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtgtcacacgccacttag

SEQ ID NO: 1334 - DNA, 18 bp, synthetic construct
  misc_feature 1..18: note = Description of sequence: modified mouse DNA tageting: SEQ ID 731(GCCTAAGTGGCGTGTGAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gtcacacgccacttaggc

SEQ ID NO: 1335 - DNA, 18 bp, synthetic construct
  misc_feature 1..18: note = Description of sequence: modified mouse DNA tageting: SEQ ID 732(TAGCCTAAGTGGCGTGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cacacgccacttaggcta

SEQ ID NO: 1336 - DNA, 18 bp, synthetic construct
  misc_feature 1..18: note = Description of sequence: modified mouse DNA tageting: SEQ ID 733(TGTAGCCTAAGTGGCGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cacgccacttaggctaca

SEQ ID NO: 1337 - DNA, 18 bp, synthetic construct
  misc_feature 1..18: note = Description of sequence: modified mouse DNA tageting: SEQ ID 734(TCTGTAGCCTAAGTGGCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cgccacttaggctacaga

SEQ ID NO: 1338 - DNA, 18 bp, synthetic construct
  misc_feature 1..18: note = Description of sequence: modified mouse DNA tageting: SEQ ID 735(ATTCTGTAGCCTAAGTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccacttaggctacagaat

SEQ ID NO: 1339 - DNA, 18 bp, synthetic construct
  misc_feature 1..18: note = Description of sequence: modified mouse DNA tageting: SEQ ID 736(TTATTCTGTAGCCTAAGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
acttaggctacagaataa

SEQ ID NO: 1340 - DNA, 18 bp, synthetic construct
  misc_feature 1..18: note = Description of sequence: modified mouse DNA tageting: SEQ ID 737(GCTTATTCTGTAGCCTAA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ttaggctacagaataagc

SEQ ID NO: 1341 - DNA, 18 bp, synthetic construct
  misc_feature 1..18: note = Description of sequence: modified mouse DNA tageting: SEQ ID 738(GAGCTTATTCTGTAGCCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aggctacagaataagctc

SEQ ID NO: 1342 - DNA, 18 bp, synthetic construct
  misc_feature 1..18: note = Description of sequence: modified mouse DNA tageting: SEQ ID 739(TAGAGCTTATTCTGTAGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gctacagaataagctcta

SEQ ID NO: 1343 - DNA, 18 bp, synthetic construct
  misc_feature 1..18: note = Description of sequence: modified mouse DNA tageting: SEQ ID 740(GGTAGAGCTTATTCTGTA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tacagaataagctctacc

SEQ ID NO: 1344 - DNA, 18 bp, synthetic construct
  misc_feature 1..18: note = Description of sequence: modified mouse DNA tageting: SEQ ID 741(GAGGTAGAGCTTATTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cagaataagctctacctc

SEQ ID NO: 1345 - DNA, 18 bp, synthetic construct
  misc_feature 1..18: note = Description of sequence: modified mouse DNA tageting: SEQ ID 742(CTGAGGTAGAGCTTATTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gaataagctctacctcag

SEQ ID NO: 1346 - DNA, 18 bp, synthetic construct
  misc_feature 1..18: note = Description of sequence: modified mouse DNA tageting: SEQ ID 743(TTCTGAGGTAGAGCTTAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ataagctctacctcagaa

SEQ ID NO: 1347 - DNA, 18 bp, synthetic construct
  misc_feature 1..18: note = Description of sequence: modified mouse DNA tageting: SEQ ID 744(GATTCTGAGGTAGAGCTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aagctctacctcagaatc

SEQ ID NO: 1348 - DNA, 18 bp, synthetic construct
  misc_feature 1..18: note = Description of sequence: modified mouse DNA tageting: SEQ ID 745(CAGATTCTGAGGTAGAGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gctctacctcagaatctg

SEQ ID NO: 1349 - DNA, 18 bp, synthetic construct
  misc_feature 1..18: note = Description of sequence: modified mouse DNA tageting: SEQ ID 746(TTCAGATTCTGAGGTAGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tctacctcagaatctgaa

SEQ ID NO: 1350 - DNA, 18 bp, synthetic construct
  misc_feature 1..18: note = Description of sequence: modified mouse DNA tageting: SEQ ID 747(TCTTCAGATTCTGAGGTA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tacctcagaatctgaaga

SEQ ID NO: 1351 - DNA, 18 bp, synthetic construct
  misc_feature 1..18: note = Description of sequence: modified mouse DNA tageting: SEQ ID 748(CCTCTTCAGATTCTGAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cctcagaatctgaagagg

SEQ ID NO: 1352 - DNA, 18 bp, synthetic construct
  misc_feature 1..18: note = Description of sequence: modified mouse DNA tageting: SEQ ID 749(TGCCTCTTCAGATTCTGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcagaatctgaagaggca

SEQ ID NO: 1353 - DNA, 18 bp, synthetic construct
  misc_feature 1..18: note = Description of sequence: modified mouse DNA tageting: SEQ ID 750(GTTGCCTCTTCAGATTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agaatctgaagaggcaac

SEQ ID NO: 1354 - DNA, 18 bp, synthetic construct
  misc_feature 1..18: note = Description of sequence: modified mouse DNA tageting: SEQ ID 751(CTGTTGCCTCTTCAGATT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aatctgaagaggcaacag

SEQ ID NO: 1355 - DNA, 18 bp, synthetic construct
  misc_feature 1..18: note = Description of sequence: modified mouse DNA tageting: SEQ ID 752(CACTGTTGCCTCTTCAGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tctgaagaggcaacagtg

SEQ ID NO: 1356 - DNA, 18 bp, synthetic construct
  misc_feature 1..18: note = Description of sequence: modified mouse DNA tageting: SEQ ID 753(GACACTGTTGCCTCTTCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgaagaggcaacagtgtc

SEQ ID NO: 1357 - DNA, 18 bp, synthetic construct
  misc_feature 1..18: note = Description of sequence: modified mouse DNA tageting: SEQ ID 754(CTGACACTGTTGCCTCTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aagaggcaacagtgtcag

SEQ ID NO: 1358 - DNA, 18 bp, synthetic construct
  misc_feature 1..18: note = Description of sequence: modified mouse DNA tageting: SEQ ID 755(CTCTGACACTGTTGCCTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gaggcaacagtgtcagag

SEQ ID NO: 1359 - DNA, 18 bp, synthetic construct
  misc_feature 1..18: note = Description of sequence: modified mouse DNA tageting: SEQ ID 756(GACTCTGACACTGTTGCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggcaacagtgtcagagtc

SEQ ID NO: 1360 - DNA, 18 bp, synthetic construct
  misc_feature 1..18: note = Description of sequence: modified mouse DNA tageting: SEQ ID 757(TGGACTCTGACACTGTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
caacagtgtcagagtcca

SEQ ID NO: 1361 - DNA, 18 bp, synthetic construct
  misc_feature 1..18: note = Description of sequence: modified mouse DNA tageting: SEQ ID 758(CATGGACTCTGACACTGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
acagtgtcagagtccatg

SEQ ID NO: 1362 - DNA, 18 bp, synthetic construct
  misc_feature 1..18: note = Description of sequence: modified mouse DNA tageting: SEQ ID 759(CCCATGGACTCTGACACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agtgtcagagtccatggg

SEQ ID NO: 1363 - DNA, 18 bp, synthetic construct
  misc_feature 1..18: note = Description of sequence: modified mouse DNA tageting: SEQ ID 760(TTCCCATGGACTCTGACA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tgtcagagtccatgggaa

SEQ ID NO: 1364 - DNA, 18 bp, synthetic construct
  misc_feature 1..18: note = Description of sequence: modified mouse DNA tageting: SEQ ID 761(TCTTCCCATGGACTCTGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcagagtccatgggaaga

SEQ ID NO: 1365 - DNA, 18 bp, synthetic construct
  misc_feature 1..18: note = Description of sequence: modified mouse DNA tageting: SEQ ID 762(CATCTTCCCATGGACTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agagtccatgggaagatg

SEQ ID NO: 1366 - DNA, 18 bp, synthetic construct
  misc_feature 1..18: note = Description of sequence: modified mouse DNA tageting: SEQ ID 763(AACATCTTCCCATGGACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agtccatgggaagatgtt

SEQ ID NO: 1367 - DNA, 18 bp, synthetic construct
  misc_feature 1..18: note = Description of sequence: modified mouse DNA tageting: SEQ ID 764(ATGTGCACCTCTGCAGCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgctgcagaggtgcacat

SEQ ID NO: 1368 - DNA, 18 bp, synthetic construct
  misc_feature 1..18: note = Description of sequence: modified mouse DNA tageting: SEQ ID 765(CTATGTGCACCTCTGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgcagaggtgcacatag

SEQ ID NO: 1369 - DNA, 18 bp, synthetic construct
  misc_feature 1..18: note = Description of sequence: modified mouse DNA tageting: SEQ ID 766(GACTATGTGCACCTCTGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcagaggtgcacatagtc

SEQ ID NO: 1370 - DNA, 18 bp, synthetic construct
  misc_feature 1..18: note = Description of sequence: modified mouse DNA tageting: SEQ ID 767(CAGACTATGTGCACCTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agaggtgcacatagtctg

SEQ ID NO: 1371 - DNA, 18 bp, synthetic construct
  misc_feature 1..18: note = Description of sequence: modified mouse DNA tageting: SEQ ID 768(CTCAGACTATGTGCACCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggtgcacatagtctgag

SEQ ID NO: 1372 - DNA, 18 bp, synthetic construct
  misc_feature 1..18: note = Description of sequence: modified mouse DNA tageting: SEQ ID 769(CACTCAGACTATGTGCAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtgcacatagtctgagtg

SEQ ID NO: 1373 - DNA, 18 bp, synthetic construct
  misc_feature 1..18: note = Description of sequence: modified mouse DNA tageting: SEQ ID 770(AGCACTCAGACTATGTGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gcacatagtctgagtgct

SEQ ID NO: 1374 - DNA, 18 bp, synthetic construct
  misc_feature 1..18: note = Description of sequence: modified mouse DNA tageting: SEQ ID 771(GCAGCACTCAGACTATGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
acatagtctgagtgctgc

SEQ ID NO: 1375 - DNA, 18 bp, synthetic construct
  misc_feature 1..18: note = Description of sequence: modified mouse DNA tageting: SEQ ID 772(CCGCAGCACTCAGACTAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atagtctgagtgctgcgg

SEQ ID NO: 1376 - DNA, 18 bp, synthetic construct
  misc_feature 1..18: note = Description of sequence: modified mouse DNA tageting: SEQ ID 773(CTGGTGGCCGGGTCTGCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agcagacccggccaccag

SEQ ID NO: 1377 - DNA, 18 bp, synthetic construct
  misc_feature 1..18: note = Description of sequence: modified mouse DNA tageting: SEQ ID 774(GGCTGGTGGCCGGGTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cagacccggccaccagcc

SEQ ID NO: 1378 - DNA, 18 bp, synthetic construct
  misc_feature 1..18: note = Description of sequence: modified mouse DNA tageting: SEQ ID 775(AAGGCTGGTGGCCGGGTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gacccggccaccagcctt

SEQ ID NO: 1379 - DNA, 18 bp, synthetic construct
  misc_feature 1..18: note = Description of sequence: modified mouse DNA tageting: SEQ ID 776(GTAAGGCTGGTGGCCGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cccggccaccagccttac

SEQ ID NO: 1380 - DNA, 18 bp, synthetic construct
  misc_feature 1..18: note = Description of sequence: modified mouse DNA tageting: SEQ ID 777(GAGTAAGGCTGGTGGCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cggccaccagccttactc

SEQ ID NO: 1381 - DNA, 18 bp, synthetic construct
  misc_feature 1..18: note = Description of sequence: modified mouse DNA tageting: SEQ ID 778(TGGAGTAAGGCTGGTGGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gccaccagccttactcca

SEQ ID NO: 1382 - DNA, 18 bp, synthetic construct
  misc_feature 1..18: note = Description of sequence: modified mouse DNA tageting: SEQ ID 779(AGTGGAGTAAGGCTGGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caccagccttactccact

SEQ ID NO: 1383 - DNA, 18 bp, synthetic construct
  misc_feature 1..18: note = Description of sequence: modified mouse DNA tageting: SEQ ID 780(GGAGTGGAGTAAGGCTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ccagccttactccactcc

SEQ ID NO: 1384 - DNA, 18 bp, synthetic construct
  misc_feature 1..18: note = Description of sequence: modified mouse DNA tageting: SEQ ID 781(GGGGAGTGGAGTAAGGCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agccttactccactcccc

SEQ ID NO: 1385 - DNA, 18 bp, synthetic construct
  misc_feature 1..18: note = Description of sequence: modified mouse DNA tageting: SEQ ID 782(CAGGGGAGTGGAGTAAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ccttactccactcccctg

SEQ ID NO: 1386 - DNA, 18 bp, synthetic construct
  misc_feature 1..18: note = Description of sequence: modified mouse DNA tageting: SEQ ID 783(TCCAGGGGAGTGGAGTAA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ttactccactcccctgga

SEQ ID NO: 1387 - DNA, 18 bp, synthetic construct
  misc_feature 1..18: note = Description of sequence: modified mouse DNA tageting: SEQ ID 784(CTTCCAGGGGAGTGGAGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
actccactcccctggaag

SEQ ID NO: 1388 - DNA, 18 bp, synthetic construct
  misc_feature 1..18: note = Description of sequence: modified mouse DNA tageting: SEQ ID 785(TCCTTCCAGGGGAGTGGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tccactcccctggaagga

SEQ ID NO: 1389 - DNA, 18 bp, synthetic construct
  misc_feature 1..18: note = Description of sequence: modified mouse DNA tageting: SEQ ID 786(TTTCCTTCCAGGGGAGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cactcccctggaaggaaa

SEQ ID NO: 1390 - DNA, 18 bp, synthetic construct
  misc_feature 1..18: note = Description of sequence: modified mouse DNA tageting: SEQ ID 787(TCTTTCCTTCCAGGGGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctcccctggaaggaaaga

SEQ ID NO: 1391 - DNA, 18 bp, synthetic construct
  misc_feature 1..18: note = Description of sequence: modified mouse DNA tageting: SEQ ID 788(GGTCTTTCCTTCCAGGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cccctggaaggaaagacc

SEQ ID NO: 1392 - DNA, 18 bp, synthetic construct
  misc_feature 1..18: note = Description of sequence: modified mouse DNA tageting: SEQ ID 789(GTGGTCTTTCCTTCCAGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
cctggaaggaaagaccac

SEQ ID NO: 1393 - DNA, 18 bp, synthetic construct
  misc_feature 1..18: note = Description of sequence: modified mouse DNA tageting: SEQ ID 790(CTGTGGTCTTTCCTTCCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tggaaggaaagaccacag

SEQ ID NO: 1394 - DNA, 18 bp, synthetic construct
  misc_feature 1..18: note = Description of sequence: modified mouse DNA tageting: SEQ ID 791(CACTGTGGTCTTTCCTTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gaaggaaagaccacagtg

SEQ ID NO: 1395 - DNA, 18 bp, synthetic construct
  misc_feature 1..18: note = Description of sequence: modified mouse DNA tageting: SEQ ID 792(CTCACTGTGGTCTTTCCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
aggaaagaccacagtgag

SEQ ID NO: 1396 - DNA, 18 bp, synthetic construct
  misc_feature 1..18: note = Description of sequence: modified mouse DNA tageting: SEQ ID 793(TACTCACTGTGGTCTTTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaaagaccacagtgagta

SEQ ID NO: 1397 - DNA, 18 bp, synthetic construct
  misc_feature 1..18: note = Description of sequence: modified mouse DNA tageting: SEQ ID 794(TTTACTCACTGTGGTCTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aagaccacagtgagtaaa

SEQ ID NO: 1398 - DNA, 18 bp, synthetic construct
  misc_feature 1..18: note = Description of sequence: modified mouse DNA tageting: SEQ ID 795(CTTTTACTCACTGTGGTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gaccacagtgagtaaaag

SEQ ID NO: 1399 - DNA, 18 bp, synthetic construct
  misc_feature 1..18: note = Description of sequence: modified mouse DNA tageting: SEQ ID 796(AACTTTTACTCACTGTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccacagtgagtaaaagtt

SEQ ID NO: 1400 - DNA, 18 bp, synthetic construct
  misc_feature 1..18: note = Description of sequence: modified mouse DNA tageting: SEQ ID 797(GCAACTTTTACTCACTGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
acagtgagtaaaagttgc

SEQ ID NO: 1401 - DNA, 18 bp, synthetic construct
  misc_feature 1..18: note = Description of sequence: modified mouse DNA tageting: SEQ ID 798(TGGCAACTTTTACTCACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtgagtaaaagttgcca

SEQ ID NO: 1402 - DNA, 18 bp, synthetic construct
  misc_feature 1..18: note = Description of sequence: modified mouse DNA tageting: SEQ ID 799(CTTGGCAACTTTTACTCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
tgagtaaaagttgccaag

SEQ ID NO: 1403 - DNA, 18 bp, synthetic construct
  misc_feature 1..18: note = Description of sequence: modified mouse DNA tageting: SEQ ID 800(TCCTTGGCAACTTTTACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agtaaaagttgccaagga

SEQ ID NO: 1404 - DNA, 18 bp, synthetic construct
  misc_feature 1..18: note = Description of sequence: modified human DNA tageting: SEQ ID 901(AGGTGCAGGCCCAGTTGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
acaactgggcctgcacct

SEQ ID NO: 1405 - DNA, 18 bp, synthetic construct
  misc_feature 1..18: note = Description of sequence: modified human DNA tageting: SEQ ID 902(TGCAGCAGGTGCAGGCCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gggcctgcacctgctgca

SEQ ID NO: 1406 - DNA, 18 bp, synthetic construct
  misc_feature 1..18: note = Description of sequence: modified human DNA tageting: SEQ ID 903(CACCTCTGCAGCAGGTGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gcacctgctgcagaggtg

SEQ ID NO: 1407 - DNA, 18 bp, synthetic construct
  misc_feature 1..18: note = Description of sequence: modified human DNA tageting: SEQ ID 904(TCAGACTACGTGCACCTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaggtgcacgtagtctga

SEQ ID NO: 1408 - DNA, 18 bp, synthetic construct
  misc_feature 1..18: note = Description of sequence: modified human DNA tageting: SEQ ID 905(CAGCACTCAGACTACGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cacgtagtctgagtgctg

SEQ ID NO: 1409 - DNA, 18 bp, synthetic construct
  misc_feature 1..18: note = Description of sequence: modified human DNA tageting: SEQ ID 906(AGTCCGCAGCACTCAGAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gtctgagtgctgcggact

SEQ ID NO: 1410 - DNA, 18 bp, synthetic construct
  misc_feature 1..18: note = Description of sequence: modified human DNA tageting: SEQ ID 907(CTGCTGAGTCCGCAGCAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  modified_base 7: mod_base = m5c
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
gtgctgcggactcagcag

SEQ ID NO: 1411 - DNA, 18 bp, synthetic construct
  misc_feature 1..18: note = Description of sequence: modified human DNA tageting: SEQ ID 908(CCGGGTCTGCTGAGTCCG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cggactcagcagacccgg

SEQ ID NO: 1412 - DNA, 18 bp, synthetic construct
  misc_feature 1..18: note = Description of sequence: modified human DNA tageting: SEQ ID 909(GCAGGCCCAGTTGTCACC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggtgacaactgggcctgc

SEQ ID NO: 1413 - DNA, 18 bp, synthetic construct
  misc_feature 1..18: note = Description of sequence: modified human DNA tageting: SEQ ID 910(GCAGGTGCAGGCCCAGTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aactgggcctgcacctgc

SEQ ID NO: 1414 - DNA, 18 bp, synthetic construct
  misc_feature 1..18: note = Description of sequence: modified human DNA tageting: SEQ ID 911(CCTCTGCAGCAGGTGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgcacctgctgcagagg

SEQ ID NO: 1415 - DNA, 18 bp, synthetic construct
  misc_feature 1..18: note = Description of sequence: modified human DNA tageting: SEQ ID 912(CGTGCACCTCTGCAGCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctgctgcagaggtgcacg

SEQ ID NO: 1416 - DNA, 18 bp, synthetic construct
  misc_feature 1..18: note = Description of sequence: modified human DNA tageting: SEQ ID 913(ACTACGTGCACCTCTGCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tgcagaggtgcacgtagt

SEQ ID NO: 1417 - DNA, 18 bp, synthetic construct
  misc_feature 1..18: note = Description of sequence: modified human DNA tageting: SEQ ID 914(AGACTACGTGCACCTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
cagaggtgcacgtagtct

SEQ ID NO: 1418 - DNA, 18 bp, synthetic construct
  misc_feature 1..18: note = Description of sequence: modified human DNA tageting: SEQ ID 915(ACTCAGACTACGTGCACC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggtgcacgtagtctgagt

SEQ ID NO: 1419 - DNA, 18 bp, synthetic construct
  misc_feature 1..18: note = Description of sequence: modified human DNA tageting: SEQ ID 916(GCACTCAGACTACGTGCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgcacgtagtctgagtgc

SEQ ID NO: 1420 - DNA, 18 bp, synthetic construct
  misc_feature 1..18: note = Description of sequence: modified human DNA tageting: SEQ ID 917(CGCAGCACTCAGACTACG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cgtagtctgagtgctgcg

SEQ ID NO: 1421 - DNA, 18 bp, synthetic construct
  misc_feature 1..18: note = Description of sequence: modified human DNA tageting: SEQ ID 918(TCCGCAGCACTCAGACTA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  modified_base 15: mod_base = m5c
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tagtctgagtgctgcgga

SEQ ID NO: 1422 - DNA, 18 bp, synthetic construct
  misc_feature 1..18: note = Description of sequence: modified human DNA tageting: SEQ ID 919(TGAGTCCGCAGCACTCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = m5c
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctgagtgctgcggactca

SEQ ID NO: 1423 - DNA, 18 bp, synthetic construct
  misc_feature 1..18: note = Description of sequence: modified human DNA tageting: SEQ ID 920(GCTGAGTCCGCAGCACTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  modified_base 9: mod_base = m5c
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gagtgctgcggactcagc

SEQ ID NO: 1424 - DNA, 18 bp, synthetic construct
  misc_feature 1..18: note = Description of sequence: modified human DNA tageting: SEQ ID 921(GTCTGCTGAGTCCGCAGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  modified_base 5: mod_base = m5c
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gctgcggactcagcagac

SEQ ID NO: 1425 - DNA, 18 bp, synthetic construct
  misc_feature 1..18: note = Description of sequence: modified human DNA tageting: SEQ ID 922(GGGTCTGCTGAGTCCGCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = m5c
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tgcggactcagcagaccc

SEQ ID NO: 1426 - DNA, 18 bp, synthetic construct
  misc_feature 1..18: note = Description of sequence: modified human DNA tageting: SEQ ID 923(GGCCGGGTCTGCTGAGTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = m5c
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gactcagcagacccggcc

SEQ ID NO: 1427 - DNA, 18 bp, synthetic construct
  misc_feature 1..18: note = Description of sequence: modified human DNA tageting: SEQ ID 924(GTGGCCGGGTCTGCTGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctcagcagacccggccac

SEQ ID NO: 1428 - DNA, 18 bp, synthetic construct
  misc_feature 1..18: note = Description of sequence: modified human DNA tageting: SEQ ID 925(AAAGAGCTATATAACCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ctggttatatagctcttt

SEQ ID NO: 1429 - DNA, 18 bp, synthetic construct
  misc_feature 1..18: note = Description of sequence: modified human DNA tageting: SEQ ID 926(TTAAAGAGCTATATAACC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA thymine nucleosid
  misc_feature 16: note = Backbone sugar is not deoxyribose e
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ggttatatagctctttaa

SEQ ID NO: 1430 - DNA, 18 bp, synthetic construct
  misc_feature 1..18: note = Description of sequence: modified human DNA tageting: SEQ ID 927(TATTAAAGAGCTATATAA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA 5-methyl cytosine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ttatatagctctttaata

SEQ ID NO: 1431 - DNA, 18 bp, synthetic construct
  misc_feature 1..18: note = Description of sequence: modified human DNA tageting: SEQ ID 928(CTTATTAAAGAGCTATAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
atatagctctttaataag

SEQ ID NO: 1432 - DNA, 18 bp, synthetic construct
  misc_feature 1..18: note = Description of sequence: modified human DNA tageting: SEQ ID 929(GACTTATTAAAGAGCTAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atagctctttaataagtc

SEQ ID NO: 1433 - DNA, 18 bp, synthetic construct
  misc_feature 1..18: note = Description of sequence: modified human DNA tageting: SEQ ID 930(CTGACTTATTAAAGAGCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agctctttaataagtcag

SEQ ID NO: 1434 - DNA, 18 bp, synthetic construct
  misc_feature 1..18: note = Description of sequence: modified human DNA tageting: SEQ ID 931(TTCTGACTTATTAAAGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctctttaataagtcagaa

SEQ ID NO: 1435 - DNA, 18 bp, synthetic construct
  misc_feature 1..18: note = Description of sequence: modified human DNA tageting: SEQ ID 932(CATTCTGACTTATTAAAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctttaataagtcagaatg

SEQ ID NO: 1436 - DNA, 18 bp, synthetic construct
  misc_feature 1..18: note = Description of sequence: modified human DNA tageting: SEQ ID 933(ATCATTCTGACTTATTAA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ttaataagtcagaatgat

SEQ ID NO: 1437 - DNA, 18 bp, synthetic construct
  misc_feature 1..18: note = Description of sequence: modified human DNA tageting: SEQ ID 934(GGATCATTCTGACTTATT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aataagtcagaatgatcc

SEQ ID NO: 1438 - DNA, 18 bp, synthetic construct
  misc_feature 1..18: note = Description of sequence: modified human DNA tageting: SEQ ID 935(AGGGATCATTCTGACTTA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
taagtcagaatgatccct

SEQ ID NO: 1439 - DNA, 18 bp, synthetic construct
  misc_feature 1..18: note = Description of sequence: modified human DNA tageting: SEQ ID 936(GTAGGGATCATTCTGACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agtcagaatgatccctac

SEQ ID NO: 1440 - DNA, 18 bp, synthetic construct
  misc_feature 1..18: note = Description of sequence: modified human DNA tageting: SEQ ID 937(AGGTAGGGATCATTCTGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tcagaatgatccctacct

SEQ ID NO: 1441 - DNA, 18 bp, synthetic construct
  misc_feature 1..18: note = Description of sequence: modified human DNA tageting: SEQ ID 938(AGAGGTAGGGATCATTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agaatgatccctacctct

SEQ ID NO: 1442 - DNA, 18 bp, synthetic construct
  misc_feature 1..18: note = Description of sequence: modified human DNA tageting: SEQ ID 939(TCAGAGGTAGGGATCATT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aatgatccctacctctga

SEQ ID NO: 1443 - DNA, 18 bp, synthetic construct
  misc_feature 1..18: note = Description of sequence: modified human DNA tageting: SEQ ID 940(AGATTCAGAGGTAGGGAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA 5-methyl cytosine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
atccctacctctgaatct

SEQ ID NO: 1444 - DNA, 18 bp, synthetic construct
  misc_feature 1..18: note = Description of sequence: modified human DNA tageting: SEQ ID 941(TCAGATTCAGAGGTAGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ccctacctctgaatctga

SEQ ID NO: 1445 - DNA, 18 bp, synthetic construct
  misc_feature 1..18: note = Description of sequence: modified human DNA tageting: SEQ ID 942(CTTCAGATTCAGAGGTAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctacctctgaatctgaag

SEQ ID NO: 1446 - DNA, 18 bp, synthetic construct
  misc_feature 1..18: note = Description of sequence: modified human DNA tageting: SEQ ID 943(CTCTTCAGATTCAGAGGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
acctctgaatctgaagag

SEQ ID NO: 1447 - DNA, 18 bp, synthetic construct
  misc_feature 1..18: note = Description of sequence: modified human DNA tageting: SEQ ID 944(GACTCTTCAGATTCAGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA 5-methyl cytosine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctctgaatctgaagagtc

SEQ ID NO: 1448 - DNA, 18 bp, synthetic construct
  misc_feature 1..18: note = Description of sequence: modified human DNA tageting: SEQ ID 945(TTGACTCTTCAGATTCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA thymine nucleosid
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctgaatctgaagagtcaa

SEQ ID NO: 1449 - DNA, 18 bp, synthetic construct
  misc_feature 1..18: note = Description of sequence: modified human DNA tageting: SEQ ID 946(GGTATTGACTCTTCAGAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atctgaagagtcaatacc

SEQ ID NO: 1450 - DNA, 18 bp, synthetic construct
  misc_feature 1..18: note = Description of sequence: modified human DNA tageting: SEQ ID 947(GCGGTATTGACTCTTCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ctgaagagtcaataccgc

SEQ ID NO: 1451 - DNA, 18 bp, synthetic construct
  misc_feature 1..18: note = Description of sequence: modified human DNA tageting: SEQ ID 948(TGGCGGTATTGACTCTTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaagagtcaataccgcca

SEQ ID NO: 1452 - DNA, 18 bp, synthetic construct
  misc_feature 1..18: note = Description of sequence: modified human DNA tageting: SEQ ID 949(TCTGGCGGTATTGACTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
agagtcaataccgccaga

SEQ ID NO: 1453 - DNA, 18 bp, synthetic construct
  misc_feature 1..18: note = Description of sequence: modified human DNA tageting: SEQ ID 950(ATTCTGGCGGTATTGACT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agtcaataccgccagaat

SEQ ID NO: 1454 - DNA, 18 bp, synthetic construct
  misc_feature 1..18: note = Description of sequence: modified human DNA tageting: SEQ ID 951(GGATTCTGGCGGTATTGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tcaataccgccagaatcc

SEQ ID NO: 1455 - DNA, 18 bp, synthetic construct
  misc_feature 1..18: note = Description of sequence: modified human DNA tageting: SEQ ID 952(CCATGGATTCTGGCGGTA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
taccgccagaatccatgg

SEQ ID NO: 1456 - DNA, 18 bp, synthetic construct
  misc_feature 1..18: note = Description of sequence: modified human DNA tageting: SEQ ID 953(CCCCATGGATTCTGGCGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = m5c
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ccgccagaatccatgggg

SEQ ID NO: 1457 - DNA, 18 bp, synthetic construct
  misc_feature 1..18: note = Description of sequence: modified human DNA tageting: SEQ ID 954(ATCTCCCCATGGATTCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
cagaatccatggggagat

SEQ ID NO: 1458 - DNA, 18 bp, synthetic construct
  misc_feature 1..18: note = Description of sequence: modified human DNA tageting: SEQ ID 955(ACATCTCCCCATGGATTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gaatccatggggagatgt

SEQ ID NO: 1459 - DNA, 18 bp, synthetic construct
  misc_feature 1..18: note = Description of sequence: modified human DNA tageting: SEQ ID 956(GAACATCTCCCCATGGAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atccatggggagatgttc

SEQ ID NO: 1460 - DNA, 18 bp, synthetic construct
  misc_feature 1..18: note = Description of sequence: modified human DNA tageting: SEQ ID 957(TCCAGAACATCTCCCCAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
atggggagatgttctgga

SEQ ID NO: 1461 - DNA, 18 bp, synthetic construct
  misc_feature 1..18: note = Description of sequence: modified human DNA tageting: SEQ ID 958(CCTCCAGAACATCTCCCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggggagatgttctggagg

SEQ ID NO: 1462 - DNA, 18 bp, synthetic construct
  misc_feature 1..18: note = Description of sequence: modified human DNA tageting: SEQ ID 959(CCCCTCCAGAACATCTCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ggagatgttctggagggg

SEQ ID NO: 1463 - DNA, 18 bp, synthetic construct
  misc_feature 1..18: note = Description of sequence: modified human DNA tageting: SEQ ID 960(CACCCCTCCAGAACATCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
agatgttctggaggggtg

SEQ ID NO: 1464 - DNA, 18 bp, synthetic construct
  misc_feature 1..18: note = Description of sequence: modified human DNA tageting: SEQ ID 961(GTCACCCCTCCAGAACAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
atgttctggaggggtgac

SEQ ID NO: 1465 - DNA, 18 bp, synthetic construct
  misc_feature 1..18: note = Description of sequence: modified human DNA tageting: SEQ ID 962(TTGTCACCCCTCCAGAAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gttctggaggggtgacaa

SEQ ID NO: 1466 - DNA, 18 bp, synthetic construct
  misc_feature 1..18: note = Description of sequence: modified human DNA tageting: SEQ ID 963(AGTTGTCACCCCTCCAGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA guanine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
tctggaggggtgacaact

SEQ ID NO: 1467 - DNA, 18 bp, synthetic construct
  misc_feature 1..18: note = Description of sequence: modified human DNA tageting: SEQ ID 964(GCCCAGTTGTCACCCCTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA guanine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gaggggtgacaactgggc

SEQ ID NO: 1468 - DNA, 18 bp, synthetic construct
  misc_feature 1..18: note = Description of sequence: modified human DNA tageting: SEQ ID 965(AGGCCCAGTTGTCACCCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggggtgacaactgggcct

SEQ ID NO: 1469 - DNA, 18 bp, synthetic construct
  misc_feature 1..18: note = Description of sequence: modified human DNA tageting: SEQ ID 966(CAGTGGCCGGGTCTGCTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cagcagacccggccactg

SEQ ID NO: 1470 - DNA, 18 bp, synthetic construct
  misc_feature 1..18: note = Description of sequence: modified human DNA tageting: SEQ ID 967(GCCAGTGGCCGGGTCTGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
gcagacccggccactggc

SEQ ID NO: 1471 - DNA, 18 bp, synthetic construct
  misc_feature 1..18: note = Description of sequence: modified human DNA tageting: SEQ ID 968(AGGCCAGTGGCCGGGTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA guanine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
agacccggccactggcct

SEQ ID NO: 1472 - DNA, 18 bp, synthetic construct
  misc_feature 1..18: note = Description of sequence: modified human DNA tageting: SEQ ID 969(TGAGGCCAGTGGCCGGGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
acccggccactggcctca

SEQ ID NO: 1473 - DNA, 18 bp, synthetic construct
  misc_feature 1..18: note = Description of sequence: modified human DNA tageting: SEQ ID 970(AGTGAGGCCAGTGGCCGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA guanine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccggccactggcctcact

SEQ ID NO: 1474 - DNA, 18 bp, synthetic construct
  misc_feature 1..18: note = Description of sequence: modified human DNA tageting: SEQ ID 971(GAAGTGAGGCCAGTGGCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ggccactggcctcacttc

SEQ ID NO: 1475 - DNA, 18 bp, synthetic construct
  misc_feature 1..18: note = Description of sequence: modified human DNA tageting: SEQ ID 972(ATGAAGTGAGGCCAGTGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ccactggcctcacttcat

SEQ ID NO: 1476 - DNA, 18 bp, synthetic construct
  misc_feature 1..18: note = Description of sequence: modified human DNA tageting: SEQ ID 973(GAATGAAGTGAGGCCAGT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
actggcctcacttcattc

SEQ ID NO: 1477 - DNA, 18 bp, synthetic construct
  misc_feature 1..18: note = Description of sequence: modified human DNA tageting: SEQ ID 974(GGGAATGAAGTGAGGCCA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA thymine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tggcctcacttcattccc

SEQ ID NO: 1478 - DNA, 18 bp, synthetic construct
  misc_feature 1..18: note = Description of sequence: modified human DNA tageting: SEQ ID 975(AGGGGAATGAAGTGAGGC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gcctcacttcattcccct

SEQ ID NO: 1479 - DNA, 18 bp, synthetic construct
  misc_feature 1..18: note = Description of sequence: modified human DNA tageting: SEQ ID 976(CCAGGGGAATGAAGTGAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA thymine nucleosid
  misc_feature 7: note = Backbone sugar is not deoxyribose e
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
ctcacttcattcccctgg

SEQ ID NO: 1480 - DNA, 18 bp, synthetic construct
  misc_feature 1..18: note = Description of sequence: modified human DNA tageting: SEQ ID 977(TCCCAGGGGAATGAAGTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA thymine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA 5-methyl cytosine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
cacttcattcccctggga

SEQ ID NO: 1481 - DNA, 18 bp, synthetic construct
  misc_feature 1..18: note = Description of sequence: modified human DNA tageting: SEQ ID 978(CCTCCCAGGGGAATGAAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
cttcattcccctgggagg

SEQ ID NO: 1482 - DNA, 18 bp, synthetic construct
  misc_feature 1..18: note = Description of sequence: modified human DNA tageting: SEQ ID 979(TTCCTCCCAGGGGAATGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA thymine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA 5-methyl cytosine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
tcattcccctgggaggaa

SEQ ID NO: 1483 - DNA, 18 bp, synthetic construct
  misc_feature 1..18: note = Description of sequence: modified human DNA tageting: SEQ ID 980(CTTTCCTCCCAGGGGAAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA thymine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA guanine nucleoside
  misc_feature 18: note = Backbone sugar is not deoxyribose
attcccctgggaggaaag

SEQ ID NO: 1484 - DNA, 18 bp, synthetic construct
  misc_feature 1..18: note = Description of sequence: modified human DNA tageting: SEQ ID 981(GTCTTTCCTCCCAGGGGA)
  source 1..18: mol_type = other DNA
  modified_base 1: mod_base = OTHER; note = beta-D-oxy-LNA thymine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA guanine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
tcccctgggaggaaagac

SEQ ID NO: 1485 - DNA, 18 bp, synthetic construct
  misc_feature 1..18: note = Description of sequence: modified human DNA tageting: SEQ ID 982(TGGTCTTTCCTCCCAGGG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA guanine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ccctgggaggaaagacca

SEQ ID NO: 1486 - DNA, 18 bp, synthetic construct
  misc_feature 1..18: note = Description of sequence: modified human DNA tageting: SEQ ID 983(TTTGGTCTTTCCTCCCAG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  modified_base 14: mod_base = OTHER; note = beta-D-oxy-LNA 5-methyl cytosine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
ctgggaggaaagaccaaa

SEQ ID NO: 1487 - DNA, 18 bp, synthetic construct
  misc_feature 1..18: note = Description of sequence: modified human DNA tageting: SEQ ID 984(ACTTTGGTCTTTCCTCCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gggaggaaagaccaaagt

SEQ ID NO: 1488 - DNA, 18 bp, synthetic construct
  misc_feature 1..18: note = Description of sequence: modified human DNA tageting: SEQ ID 985(TCACTTTGGTCTTTCCTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA guanine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA guanine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gaggaaagaccaaagtga

SEQ ID NO: 1489 - DNA, 18 bp, synthetic construct
  misc_feature 1..18: note = Description of sequence: modified human DNA tageting: SEQ ID 986(ATTCACTTTGGTCTTTCC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA guanine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA guanine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
ggaaagaccaaagtgaat

SEQ ID NO: 1490 - DNA, 18 bp, synthetic construct
  misc_feature 1..18: note = Description of sequence: modified human DNA tageting: SEQ ID 987(TTATTCACTTTGGTCTTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  modified_base 4: mod_base = OTHER; note = beta-D-oxy-LNA guanine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA 5-methyl cytosine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA 5-methyl cytosine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA adenine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA thymine nucleosid
  misc_feature 16: note = Backbone sugar is not deoxyribose e
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
aaagaccaaagtgaataa

SEQ ID NO: 1491 - DNA, 18 bp, synthetic construct
  misc_feature 1..18: note = Description of sequence: modified human DNA tageting: SEQ ID 988(GTTTATTCACTTTGGTCT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA guanine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA 5-methyl cytosine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA guanine nucleoside
  misc_feature 11: note = Backbone sugar is not deoxyribose
  misc_feature 11^12: note = phosphorothioate internucleoside linkage
  modified_base 12: mod_base = OTHER; note = beta-D-oxy-LNA adenine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA adenine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
agaccaaagtgaataaac

SEQ ID NO: 1492 - DNA, 18 bp, synthetic construct
  misc_feature 1..18: note = Description of sequence: modified human DNA tageting: SEQ ID 989(AGCTGTTTATTCACTTTG)
  source 1..18: mol_type = other DNA
  modified_base 1: mod_base = OTHER; note = beta-D-oxy-LNA 5-methyl cytosine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA adenine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  modified_base 11: mod_base = OTHER; note = beta-D-oxy-LNA adenine nucleoside
  misc_feature 11: note = Backbone sugar is not deoxyribose
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  misc_feature 15^16: note = phosphorothioate internucleoside linkage
  modified_base 16: mod_base = OTHER; note = beta-D-oxy-LNA guanine nucleoside
  misc_feature 16: note = Backbone sugar is not deoxyribose
  misc_feature 16^17: note = phosphorothioate internucleoside linkage
  modified_base 17: mod_base = OTHER; note = beta-D-oxy-LNA 5-methyl cytosine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
caaagtgaataaacagct

SEQ ID NO: 1493 - DNA, 18 bp, synthetic construct
  misc_feature 1..18: note = Description of sequence: modified human DNA tageting: SEQ ID 990(GAAGCTGTTTATTCACTT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA adenine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA guanine nucleoside
  misc_feature 5: note = Backbone sugar is not deoxyribose
  misc_feature 5^6: note = phosphorothioate internucleoside linkage
  modified_base 6: mod_base = OTHER; note = beta-D-oxy-LNA adenine nucleoside
  misc_feature 6: note = Backbone sugar is not deoxyribose
  misc_feature 6^7: note = phosphorothioate internucleoside linkage
  misc_feature 7^8: note = phosphorothioate internucleoside linkage
  modified_base 8: mod_base = OTHER; note = beta-D-oxy-LNA thymine nucleoside
  misc_feature 8: note = Backbone sugar is not deoxyribose
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  modified_base 13: mod_base = OTHER; note = beta-D-oxy-LNA adenine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA 5-methyl cytosine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA thymine nucleosid
  misc_feature 17: note = Backbone sugar is not deoxyribose e
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
aagtgaataaacagcttc

SEQ ID NO: 1494 - DNA, 18 bp, synthetic construct
  misc_feature 1..18: note = Description of sequence: modified human DNA tageting: SEQ ID 991(TTGAAGCTGTTTATTCAC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  modified_base 2: mod_base = OTHER; note = beta-D-oxy-LNA thymine nucleoside
  misc_feature 2: note = Backbone sugar is not deoxyribose
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA adenine nucleoside
  misc_feature 4: note = Backbone sugar is not deoxyribose
  misc_feature 4^5: note = phosphorothioate internucleoside linkage
  misc_feature 5^6: note = phosphorothioate internucleoside linkage
  modified_base 6: mod_base = OTHER; note = beta-D-oxy-LNA thymine nucleoside
  misc_feature 6: note = Backbone sugar is not deoxyribose
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  modified_base 9: mod_base = OTHER; note = beta-D-oxy-LNA adenine nucleoside
  misc_feature 9: note = Backbone sugar is not deoxyribose
  misc_feature 9^10: note = phosphorothioate internucleoside linkage
  modified_base 10: mod_base = OTHER; note = beta-D-oxy-LNA 5-methyl cytosine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA thymine nucleosid
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA adenine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA adenine nucleoside
  misc_feature 18: note = Backbone sugar is not deoxyribose
gtgaataaacagcttcaa

SEQ ID NO: 1495 - DNA, 18 bp, synthetic construct
  misc_feature 1..18: note = Description of sequence: modified human DNA tageting: SEQ ID 992(ACTTGAAGCTGTTTATTC)
  source 1..18: mol_type = other DNA
  modified_base 1: mod_base = OTHER; note = beta-D-oxy-LNA guanine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  misc_feature 3^4: note = phosphorothioate internucleoside linkage
  modified_base 4: mod_base = OTHER; note = beta-D-oxy-LNA thymine nucleoside
  misc_feature 4: note = Backbone sugar is not deoxyribose
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  modified_base 8: mod_base = OTHER; note = beta-D-oxy-LNA 5-methyl cytosine nucleoside
  misc_feature 8: note = Backbone sugar is not deoxyribose
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA thymine nucleoside
  misc_feature 12: note = Backbone sugar is not deoxyribose
  misc_feature 12^13: note = phosphorothioate internucleoside linkage
  modified_base 13: mod_base = OTHER; note = beta-D-oxy-LNA thymine nucleoside
  misc_feature 13: note = Backbone sugar is not deoxyribose
  misc_feature 13^14: note = phosphorothioate internucleoside linkage
  misc_feature 14^15: note = phosphorothioate internucleoside linkage
  modified_base 15: mod_base = OTHER; note = beta-D-oxy-LNA adenine nucleoside
  misc_feature 15: note = Backbone sugar is not deoxyribose
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA thymine nucleosid
  misc_feature 18: note = Backbone sugar is not deoxyribose e
gaataaacagcttcaagt

SEQ ID NO: 1496 - DNA, 18 bp, synthetic construct
  misc_feature 1..18: note = Description of sequence: modified human DNA tageting: SEQ ID 993(GCACTTGAAGCTGTTTAT)
  source 1..18: mol_type = other DNA
  modified_base 1: mod_base = OTHER; note = beta-D-oxy-LNA adenine nucleoside
  misc_feature 1: note = Backbone sugar is not deoxyribose
  misc_feature 1^2: note = phosphorothioate internucleoside linkage
  misc_feature 2^3: note = phosphorothioate internucleoside linkage
  modified_base 3: mod_base = OTHER; note = beta-D-oxy-LNA adenine nucleoside
  misc_feature 3: note = Backbone sugar is not deoxyribose
  misc_feature 3^4: note = phosphorothioate internucleoside linkage
  misc_feature 4^5: note = phosphorothioate internucleoside linkage
  modified_base 5: mod_base = OTHER; note = beta-D-oxy-LNA adenine nucleoside
  misc_feature 5: note = Backbone sugar is not deoxyribose
  misc_feature 5^6: note = phosphorothioate internucleoside linkage
  misc_feature 6^7: note = phosphorothioate internucleoside linkage
  modified_base 7: mod_base = OTHER; note = beta-D-oxy-LNA adenine nucleoside
  misc_feature 7: note = Backbone sugar is not deoxyribose
  misc_feature 7^8: note = phosphorothioate internucleoside linkage
  misc_feature 8^9: note = phosphorothioate internucleoside linkage
  misc_feature 9^10: note = phosphorothioate internucleoside linkage
  modified_base 10: mod_base = OTHER; note = beta-D-oxy-LNA thymine nucleoside
  misc_feature 10: note = Backbone sugar is not deoxyribose
  misc_feature 10^11: note = phosphorothioate internucleoside linkage
  misc_feature 11^12: note = phosphorothioate internucleoside linkage
  modified_base 12: mod_base = OTHER; note = beta-D-oxy-LNA 5-methyl cytosine nucleoside
  misc_feature 12: note = Backbone sugar is not deoxyribose
  misc_feature 12^13: note = phosphorothioate internucleoside linkage
  misc_feature 13^14: note = phosphorothioate internucleoside linkage
  modified_base 14: mod_base = OTHER; note = beta-D-oxy-LNA adenine nucleoside
  misc_feature 14: note = Backbone sugar is not deoxyribose
  misc_feature 14^15: note = phosphorothioate internucleoside linkage
  misc_feature 15^16: note = phosphorothioate internucleoside linkage
  misc_feature 16^17: note = phosphorothioate internucleoside linkage
  modified_base 17: mod_base = OTHER; note = beta-D-oxy-LNA guanine nucleoside
  misc_feature 17: note = Backbone sugar is not deoxyribose
  misc_feature 17^18: note = phosphorothioate internucleoside linkage
  modified_base 18: mod_base = OTHER; note = beta-D-oxy-LNA 5-methyl cytosine nucleoside
  misc_feature 18: note = Backbone sugar is not deoxyribose
ataaacagcttcaagtgc

SEQ ID NO: 1497 - DNA, 18 bp, sythetic construct
  misc_feature 1..18: note = Description of sequence: Primer 2
  source 1..18: mol_type = other DNA
gttcctccagattggcag

SEQ ID NO: 1498 - DNA, 19 bp, sythetic construct
  misc_feature 1..19: note = Description of sequence: Primer 1
  source 1..19: mol_type = other DNA
ccaggagttaagaactcgc

SEQ ID NO: 1499 - DNA, 23 bp, sythetic construct
  misc_feature 1..23: note = Description of sequence: Probe
  source 1..23: mol_type = other DNA
  modified_base <1: mod_base = OTHER; note = Hexachlorofluorescein fluorescent dye
  modified_base 9^10: mod_base = OTHER; note = ZEN internal quencher
  modified_base >23: mod_base = OTHER; note = 3' Iowa Black FQ fluorescent dye
cggagtccaagggaaatggagta

SEQ ID NO: 1500 - DNA, 18 bp, sythetic construct
  misc_feature 1..18: note = Description of sequence: Primer 2
  source 1..18: mol_type = other DNA
gttcctccagattggcag

SEQ ID NO: 1501 - DNA, 19 bp, sythetic construct
  misc_feature 1..19: note = Description of sequence: Primer 1
  source 1..19: mol_type = other DNA
ccaggagttaagaactcgc

SEQ ID NO: 1502 - DNA, 26 bp, sythetic construct
  misc_feature 1..26: note = Description of sequence: Probe
  source 1..26: mol_type = other DNA
  modified_base <1: mod_base = OTHER; note = 5' 6-FAM Fluorescein modification
  modified_base 9^10: mod_base = OTHER; note = ZEN internal quencher
  modified_base >26: mod_base = OTHER; note = 3' Iowa Black FQ fluorescent dye
cggagtccaagtctgatatccttttg

SEQ ID NO: 1503 - DNA, 16 bp, sythetic construct
  misc_feature 1..16: note = Description of sequence: Primer 2
  source 1..16: mol_type = other DNA
agggtccaacttgtcc

SEQ ID NO: 1504 - DNA, 19 bp, sythetic construct
  misc_feature 1..19: note = Description of sequence: Primer 1
  source 1..19: mol_type = other DNA
ctggatcctgacgaggttc

SEQ ID NO: 1505 - DNA, 24 bp, sythetic construct
  misc_feature 1..24: note = Description of sequence: Probe
  source 1..24: mol_type = other DNA
  modified_base <1: mod_base = OTHER; note = Hexachlorofluorescein fluorescent dye
  modified_base 9^10: mod_base = OTHER; note = ZEN internal quencher modified_base
  modified_base >24: mod_base = OTHER; note = 3' Iowa Black FQ fluorescent dye
cttactccactccccttggcctcc

SEQ ID NO: 1506 - DNA, 27 bp, sythetic construct
  misc_feature 1..27: note = Description of sequence: Probe
  source 1..27: mol_type = other DNA
  modified_base <1: mod_base = OTHER; note = 5' 6-FAM Fluorescein modification
  modified_base >27: mod_base = OTHER; note = 3' Iowa Black FQ fluorescent dye
cccaaaaggatatcagacttggcctcc

The invention claimed is:

1. A method for recombinantly producing a multimeric polypeptide comprising the steps of:

a) cultivating a mammalian cell, which is expressing XBP1 and which comprises one or more nucleic acids encoding and expressing the multimeric polypeptide;

b) recombinantly producing the multimeric polypeptide; and c) recovering the multimeric polypeptide from the cells or a cultivation medium, characterized in that the cultivating is in the presence of an antisense oligonucleotide, which is inducing a formation of the XBP1 variant XBP1Δ4.

2. The method according to claim 1, comprising the steps of:

a1) propagating a mammalian cell, which is expressing XBP1 and which comprises one or more nucleic acids encoding and expressing the multimeric polypeptide, in a cultivation medium comprising an antisense oligonucleotide, which is inducing formation of the XBP1 variant XBP1Δ4, to obtain a first cell population;

a2) mixing an aliquot of the first cell population with cultivation medium to obtain a second cell population, wherein the cultivation medium optionally comprises the antisense oligonucleotide, which is inducing formation of the XBP1 variant XBP1Δ4;

a3) cultivating the second cell population to obtain a third cell population;

b) recombinantly producing the multimeric polypeptide in the third cell population; and c) recovering the multimeric polypeptide from the the third cell population and/or the cultivation medium thereof.

3. The method according to claim 1, characterized in that the antisense oligonucleotide is 8-40 nucleotides in length and comprises a contiguous nucleotide sequence of 8-40 nucleotides in length, which is complementary to a mammalian XBP1 pre-mRNA transcript.

4. The method according to claim 3, characterized in that the contiguous nucleotide sequence is complementary to at least 10 contiguous nucleotides of a hamster XBP1 pre-mRNA transcript (SEQ ID NO 1).

5. The method according to claim 1, characterized in that the antisense oligonucleotide is selected from the group consisting of SEQ ID NO 8, SEQ ID NO 10, SEQ ID NO 11, SEQ ID NO 13, SEQ ID NO 14, SEQ ID NO 15, SEQ ID NO 16, SEQ ID NO 17, SEQ ID NO 18, SEQ ID NO 19, SEQ ID NO 23, SEQ ID NO 24, SEQ ID NO 25, SEQ ID NO 26, SEQ ID NO 27, SEQ ID NO 28, SEQ ID NO 32, SEQ ID NO 34, SEQ ID NO 36, SEQ ID NO 37, SEQ ID NO 39, SEQ ID NO 40, SEQ ID NO 41, SEQ ID NO 42, SEQ ID NO 43, SEQ ID NO 45, SEQ ID NO 46, SEQ ID NO 94, SEQ ID NO 95, SEQ ID NO 96, SEQ ID NO 97, SEQ ID NO 99, SEQ ID NO 100, SEQ ID NO 101, SEQ ID NO 102, SEQ ID NO 103, SEQ ID NO 104, SEQ ID NO 105, SEQ ID NO 106, SEQ ID NO 107, SEQ ID NO 108, SEQ ID NO 110, SEQ ID NO 111, SEQ ID NO 128, SEQ ID NO 140, SEQ ID NO 141, SEQ ID NO 142, SEQ ID NO 143, SEQ ID NO 147, SEQ ID NO 148, SEQ ID NO 149, SEQ ID NO 150, SEQ ID NO 151, SEQ ID NO 158, SEQ ID NO 193, SEQ ID NO 194, SEQ ID NO 195, SEQ ID NO 196, SEQ ID NO 197, SEQ ID NO 198, SEQ ID NO 199, SEQ ID NO 200, SEQ ID NO 201, SEQ ID NO 202, SEQ ID NO 203, SEQ ID NO 204, SEQ ID NO 205, SEQ ID NO 206, SEQ ID NO 207, SEQ ID NO 208, SEQ ID NO 209, SEQ ID NO 210, SEQ ID NO 211, SEQ ID NO 212, SEQ ID NO 214, SEQ ID NO 215, SEQ ID NO 216, SEQ ID NO 217, SEQ ID NO 218, SEQ ID NO 219, SEQ ID NO 220, SEQ ID NO 221, SEQ ID NO 222, SEQ ID NO 224, SEQ ID NO 226, SEQ ID NO 229, SEQ ID NO 281, SEQ ID NO 282, SEQ ID NO 285, SEQ ID NO 286, SEQ ID NO 297 and SEQ ID NO 298.

6. The method according to claim 3, characterized in that the contiguous nucleotide sequence is the same length as the antisense oligonucleotide.

7. The method according to claim 1, characterized in that the antisense oligonucleotide or contiguous nucleotide sequence thereof comprises one or more modified nucleotides or one or more modified nucleosides.

8. The method according to claim 1, characterized in that the antisense oligonucleotide or contiguous nucleotide sequence thereof comprises one or more modified nucleosides, such as one or more modified nucleotides independently selected from the group consisting of 2'-O-alkyl-RNA; 2'-O-methyl RNA (2'-OMe); 2'-alkoxy-RNA; 2'-O-methoxyethyl-RNA (2'-MOE); 2'-amino-DNA; 2'-fluro-RNA; 2'-fluoro-DNA; arabino nucleic acid (ANA); 2'-fluoro-ANA; bicyclic nucleoside analog (LNA); or any combination thereof.

9. The method according to claim 8, characterized in that the nucleotide sequence of the antisense oligonucleotide or contiguous nucleotide sequence thereof is selected from the group consisting of SEQ ID NOs: 1011-1496.

10. The method according to claim 1, characterized in that one or more internucleoside linkages within a contiguous nucleotide sequence of the antisense oligonucleotide are modified.

11. The method according to claim 9, characterized in that at least about 75% of the internucleoside linkages within the antisense oligonucleotide are modified.

12. The method according to claim 1, characterized in that the antisense oligonucleotide is added to a final concentration of 25 μM or more.

13. The method according to according to claim 1, characterized in that the cultivating is with a starting cell density of 1*10E6 to 2*10E6 cells/mL.

14. The method according to claim 13, characterized in that the starting cell density is about 2*10E6 cells/mL.

15. The method according to claim 1, characterized in that the mammalian cell is a CHO cell.

16. The method according to claim 1, characterized in that the multimeric polypeptide is an antibody.

* * * * *